US007939271B2

(12) United States Patent
Jooss et al.

(10) Patent No.: US 7,939,271 B2
(45) Date of Patent: May 10, 2011

(54) METHODS AND COMPOSITIONS FOR IDENTIFYING PROSTATE CANCER OR A HUMORAL IMMUNE RESPONSE AGAINST PROSTATE CANCER

(75) Inventors: Karin Jooss, Bellevue, WA (US); Thomas Harding, San Francisco, CA (US); Minh Nguyen, San Francisco, CA (US); Kathryn E. Koprivnikar, Cupertino, CA (US)

(73) Assignee: BioSante Pharmaceuticals, Inc., Lincolnshire, IL (US)

( * ) Notice: Subject to any disclaimer, the term of this patent is extended or adjusted under 35 U.S.C. 154(b) by 526 days.

(21) Appl. No.: 12/041,369

(22) Filed: Mar. 3, 2008

(65) Prior Publication Data

US 2008/0279831 A1 Nov. 13, 2008

Related U.S. Application Data

(60) Provisional application No. 60/904,688, filed on Mar. 2, 2007, provisional application No. 60/978,029, filed on Oct. 5, 2007.

(51) Int. Cl.
*C12Q 1/00* (2006.01)
*G01N 33/53* (2006.01)
(52) U.S. Cl. .................. 435/7.1; 435/4; 435/5; 435/6
(58) Field of Classification Search .................. None
See application file for complete search history.

(56) References Cited

U.S. PATENT DOCUMENTS

| 5,637,483 | A | 6/1997 | Dranoff |
| 5,904,920 | A | 5/1999 | Dranoff |
| 5,985,290 | A | 11/1999 | Jaffee |
| 6,033,674 | A | 3/2000 | Jaffee |
| 6,277,368 | B1 | 8/2001 | Hiserodt |
| 6,350,445 | B1 | 2/2002 | Jaffee |
| 6,464,973 | B1 | 10/2002 | Levitsky |
| 7,339,089 | B2 * | 3/2008 | Gotoh ............................ 800/18 |
| 7,666,985 | B2 * | 2/2010 | Sugiyama et al. ............ 530/328 |
| 2006/0057127 | A1 | 3/2006 | Liu et al. |

FOREIGN PATENT DOCUMENTS

| WO | WO00/26676 | 5/2000 |
| WO | WO00/72686 | 12/2000 |

OTHER PUBLICATIONS

Hege et al. Intl Rev Immunol 2006;25:321-52.*
Ogata et al. Prostate 2004;60:273-81.*
Abe et al., Antitumor effect induced by granulocyte/macrophage-colony-stimulating factor gene-modified tumor vaccination: comparison of adenovirus- and retrovirus-mediated genetic transduction. J. Canc. Res. Clin. Oncol. 121: 587-592 (1995).
Adams, M.D., Kerlavage, A.R., Fleischmann, R.D., Fuldner, R.A., Bult, C.J., Lee, N.H., Kirkness, E.F., Weinstock, K.G., Gocayne, J.D., White, O. et al. Initial assessment of human gene diversity and expression patterns based upon 83 million nucleotides of cDNA sequence. Nature 377 (6547 SUPPL), 3-174 (1995).
Altschul et al., Basic Local Alignment Search Tool. J. Mol. Biol. 215: 403-410 (1990).
An, S., Cho, K.H., Lee, W.S., Lee, J.O., Paik, Y.K. and Jeong, T.S. A critical role for the histidine residues in the catalytic function of acyl-CoA: cholesterol acyltransferase catalysis: evidence for catalytic difference between ACAT1 and ACAT2. Lett. 580 (11), 2741-2749 (2006) PMID 16647063.
Aoki et al., Expression of marine interleukin 7 in a murine glioma cell line results in reduced tumorigenicity in vivo. Proc Natl Acad Sci USA. 89(9):3850-4, 1992.
Armstrong T. D. and Jaffee E. M., Cytokine modified tumor vaccines. Surg Oncol Clin N Am. 11(3):681-96, 2002.
Asano, K., Kinzy, T.G., Merrick W.C. and Hershey, J.W. Conservation and diversity of eukaryotic translation initiation factor eIF3, J. Biol. Chem. 272 (2), 1101-1109 (1997). PMID 8995409.
Balakirev, M.Y., Tchemiuk, S.O., Jaquinod, M. and Chroboczek, J. Otubains: a new family of cysteine proteases in the ubiquitin pathway. EMBO Rep. 4 (5), 517-522 (2003).
Bartee, E., Mansouri, M., Hovey Nerenberg, B.T., Gouveia, K. and Fruh, K. Downregulation of major histocompatibility complex class 1 by human ubiquitin ligases related to viral immune evasion proteins. J. Virol. 78 (3), 1109-1120 (2004) PMID 14722266.
Batzer et al., Enhanced evolutionary PCR using oligonucleotides with inosine at the 3'-terminus. Nucleic Acid Res. 19: 5081 (1991).
Bell, S.P., Learned, R.M., Jantzen, H.M. and Tjian, R. Functional cooperativity between transcription factors UBF1 and SL1 mediates human ribosomal RNA synthesis. Science 241 (4870), 1192-1197 (1988) PMID 3413483.
Bennett, M.J., Hosking G.P., Smith, M.F., Gray. R.G. and Middleton, B. Biochemical investigations on a patient with a defect in cytosolic acetoacetyl-CoA thiolase, associated with mental retardation. J. Inherit. Metab. Dis. 7(3), 125-128 (1984) PMID 6150136.
Bilbe, G., Delabie, J., Bruggen, J., Richener, H., Asselbergs, F.A., Cerletti, N., Sorg, C., Odink, K., Tarcsay, L., Wiesendanger, W. et al. Restin: a novel intermediate filament-associated protein highly expressed in the Reed-Sternberg cells of Hodgkin's disease. EMBO J. 11 (6), 2103-2113 (1992) PMID 1600942.
Bodey, B. et al., Failure of Cancer Vaccines: The Significant Limitations of this Approach to Immunotherapy. Anticancer Res 20(4):2665-76, 2000.
Bomont, P., Maddox, P., Shah, J.V., Desai, A.B. and Cleveland, D.W. Unstable microtubule capture at kinetochores depleted of the centromere-associated protein CENP-F, EMBO J. 24 (22), 3927-3939 (2005) PMID 16252009.
Boon and Old, Cancer Tumor Antigens. Curr Opin Immunol. Oct. 1, 1997; 9(5):681-683.
Borello and Pardoll, GM-CSF-based cellular vaccines: a review of the clinical experience, Growth Factor Rev. 13(2):185-93, 2002.
Bradford, T.J., Wang, X., Chinnaiyan, A.M. Cancer immunomics: using autoantibody signatures in the early detection of prostate cancer. Urol Oncol. May-Jun. 2006;24(3):237-42 PMID 16678056.

(Continued)

*Primary Examiner* — Q. Janice Li
(74) *Attorney, Agent, or Firm* — Jones Day

(57) ABSTRACT

The present invention relates to prostate cancer markers, compositions comprising such markers, immunoglobulins specific for such markers, and methods of using such markers and/or immunoglobulins to assess an immune response against prostate cancer. An immune response against the markers correlates with an immune response, in particular a humoral immune response, against prostate cancer cells which immune response is preferably associated with prophylaxis of prostate cancer, treatment of prostate cancer, and/or amelioration of at least one symptom associated with prostate cancer.

57 Claims, 22 Drawing Sheets

OTHER PUBLICATIONS

Figure 1:
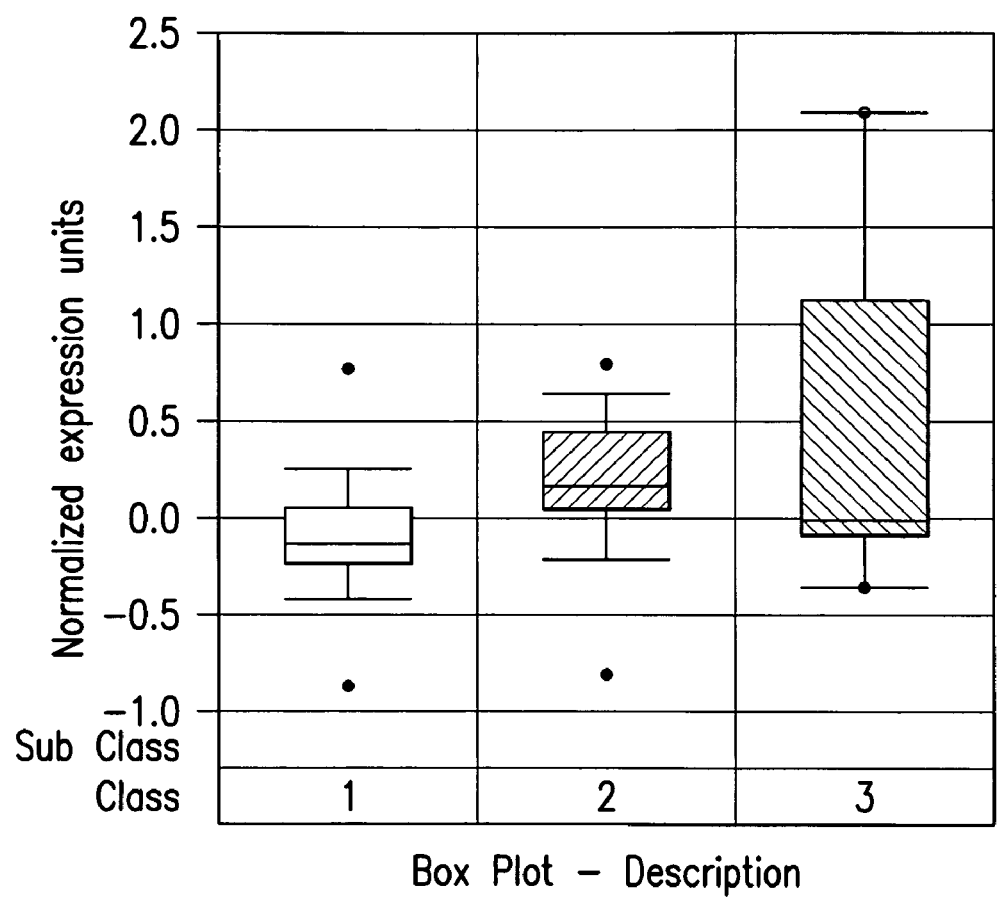

Bruderer, R.M., Brasseur, C., Meyer, H.H. The AAA ATPase p97/VCP interacts with its alternative co-factors, Ufd1-Np14 and p47, through a common bipartite binding mechanism. J Biol Chem. Nov. 26, 2004; 279(48):49609-16. Epub Sep. 15, 2004 PMID 15371428.

Burstein, E., Hoberg, J.E., Wilkinson, A.S., Rumble, J.M., Csomos, R.A., Komarck, C.M., Maine, G.N., Wilkinson, J.C., Mayo, M.W., Duckett, C.S., COMMD proteins, a novel family of structural and functional homologs of MURR1, J. Biol. Chem. 280 (23), 22222-22232 (2005).

Cantrell et al., Cloning, sequence, and expression of a human granulocyte/macrophage colony-stimulating factor. Proc. Natl. Acad. Sci., 82, 6250-6254, 1985.

Cárcamo, C., Pardo, E., Oyanadel, C., Bravo-Zehnder, M., Bull, P., Caceres, M., Martinez, J., Massardo, L., Jacobelli, S., Gonzalez, A, Soza, A. Galectin-8 binds specific beta1 integrins and induces polarized spreading highlighted by asymmetric lamellipodia in Jurkat T cells. Exp. Cell Res. 312 (4), 374-386 (2006).

Carlsson, S., Oberg, C.T., Carlsson, M.C., Sundin, A., Nilsson, U.J., Smith, D., Cummings, R.D., Almkvist, J., Karlsson, A. and Leffler, H. Affinity of galectin-8 and its carbohydrate recognition domains for ligands in solution and at the cell surface. Glycobiology 17 (6), 663-676 (2007).

Casiano, C.A., Mediavilla-Varela, M. Tan, E.M. Tumor-associated antigen arrays for the serological diagnosis of cancer. Mol Cell Proteomics. Oct. 2006;5(10):1745-59. Epub May 29, 2006 PMID 16733262.

Cha, H., Dangi, S., Machamer, C.E. and Shapiro, P. Inhibition of mixed-lineage kinase (MLK) activity during G2-phase disrupts microtubule formation and mitotic progression in HeLa cells, Cell. Signal. 18 (1), 93-104 (2006).

Chadee, D.N. and Kyriakis, J.M. MLK3 is required for mitogen activation of B-Raf, ERK and cell proliferation. Nat. Cell Biol. 6 (8), 770-776 (2004) PMID 15258589.

Chang A et al., Immunogenetic Therapy of Human Melanoma Utilizing Autologous Tumor Cells Transduced to Secrete Granulocyte-Macrophage Colony-Stimulating Factor. Human Gene Therapy 11:839-850, 2000.

Chaudhuri, J., Chakrabarti and Maitra, U. Biochemical characterization of mammalian translation initiation factor 3 (eIF3). Molecular cloning reveals that p110 subunit is the mammalian homologue or Sarcharomyces cerevisiae protein Prt1. J. Biol. Chem. 272 (49), 30975-30983 (1997) PMID 9388245.

Chen, H., Chedotal, A., He, Z., Goodman, C.S. and Tessier-Lavigne, M, Neuropilin-2, a novel member of the neuropilin family, is a high affinity receptor for the semaphorins Sema E and Sema IV but not Sema III, Neuron 19 (3), 547-559 (1997).

Chen, H., He, Z., Bagri, A. and Tessier-Lavigne, M., Semaphorin-neuropilin interactions underlying sympathetic axon responses to class III semaphorins, Neuron 21 (6), 1283-1290 (1998).

Chen, Y., Sharp, Z.D. and Lee, W.H. HEC binds to the seventh regulatory subunit of the 26 S proteasome and modulates the proteolysis of mitotic cyclins J. Biol. Chem. 272 (38), 24081-24087 (1997) PMID 9295362.

Ciferri, C., De Luca, J., Monzani, S., Ferrari, K.J., Ristic, D., Wyman, C., Stark, H., Kilmartin, J., Salmon, E.D. and Musacchio, A. Architecture of the human ridc80-hec 1 complex, a critical constituent of the outer kinetochore J. Biol. Chem. 280 (32), 29088-29095 (2005) PMID: 15961401.

Ciszak, E.M., Makal, A., Hong, Y.S., Vettaikkorumakankauv, A.K., Korotchkina, L.G. and Patel, M.S., How dihydrolipoamide dehydrogenase-binding protein binds dihydrolipoamide dehydrogenase in the human pyruvate dehydrogenase complex, J. Biol. Chem. 281 (1), 648-655 (2006).

Coux, O., Tanaka, K. and Goldberg, A.L. Structure and functions of the 20S and 26S proteasomes Annu, Rev. Biochem. 65, 801-847 (1996) PMID 8811196.

Darrow et al., The Role of HLA Class I Antigens in Recognition of Melanoma Cells by Tumor-Specific Cytotoxic T Lymphocytes. J. Immunol., 142, 3329-3335 (1989).

Defeo-Jones, D., Huang, P.S., Jones, R.E., Haskell, K.M., Vuocolo, G.A., Hanobik, M.G., Huber, H.E. and Oliff; A. Cloning of cDNAs for cellular proteins that bind to the retinoblastoma gene product. Nature 352 (6332), 251-254 (1991). PMID: 1857421.

DeLuca, J.G., Gall, W.E.; Ciferri, C., Cimini, D., Musacchio, A. and Salmon, E.D. Kinetochore microtubule dynamics and attachment stability are regulated by Hec1 Cell 127 (5), 969-982 (2006). PMID: 17129782.

DeLuca-Flaherty, C., McKay, D.B., Parham, P. and Hill, B.L. Uncoating protein (hsc70) binds a conformationally labile domain of clathrin light chain LCa to stimulate ATP hydrolysis. Cell 62 (5), 875-887 (1990) PMID 1975516.

Devita et al. (eds.) Chapter 6 The History of Cancer Immunotherapy, Biologic Therapy of Cancer, J. Lippincott Co., pp. 87-199, 1991.

Dou, D. and Joseph, R. Cloning of human neuronatin gene and its localization to chromosome-20q 11.2-12: the deduced protein is a novel 'proteolipid' Brain Res. 723 (1-2), 8-22 (1996) PMID 8813377.

Dou, D. and Joseph, R. Structure and organization of the human neuronatin gene Genomics 33 (2), 292-297 (1996b) PMID 8660979.

Dranoff et al., Vaccination of irradiated tumor cells engineered to secrete murine granulocyte-macrophage colony-stimulating factor stimulates potent, specific, and long-lasting anti-tumor immunity. PNAS 90:3539-3543, 1993.

Dunphy, E.J., McNeel, D.G. Antigen-specific IgG elicited in subjects with prostate cancer treated withflt3 ligand. J lmmunother. May-Jun. 2005;28(3):268-75.

Dworniczak, B. and Mirault, M.E. Structure and expression of a human gene coding for a 71 kd heat shock 'cognate' protein. Nucleic Acids Res. 15 (13), 5181-5197 (1987) PMID 3037489.

Ermini, L., Secciani, F., La Sala, G.B., Sabatini, L., Fineschi, D., Hale, G. and Rosati, F. Different glycoforms of the human GPI-anchored antigen CD52 associate differently with lipid microdomains in leukocytes and sperm membranes. Biochem. Biophys. Res. Commun. 338 (2), 1275-1283 (2005) PMID 16266689.

Faber, P.W., Barnes, G.T., Srinidhi, J., Chen, J., Gusella, J.F., MacDonald, M.E. Huntingtin interacts with a family of WW domain proteins. Hum Mol Genet. Sep. 1998;7(9):1463-74 PMID 9700202.

Fattaey, A.R., Helin, K., Dembski, M.S., Dyson, N., Harlow, E., Vuocolo G.A., Hanobik, M.G., Haskell, K.M., Oliff, A., Defeo-Jones, D. et al, Characterization of the retinoblastoma binding proteins RBP1 and RBP2. Oncogene 8 (11), 3149-3156 (1993) PMID 8414517.

Fearon, E.R. et al., Interleukin-2 Production by Tumor Cells Bypasses T Helper Function in the Generation of an Antitumor Response. Cell 60:397-403, 1990.

Feng, J., Huang, H. and Yen, T.J. CENP-F is a novel microtubule-binding protein that is essential for kinetochore attachments and affects the duration of the mitotic checkpoint delay. Chromosoma 115 (4), 320-329 (2006) PMID 16601978.

Feng, Y., Walsh, C.A. The many faces of filamin: a versatile molecular scaffold for cell motility and signaling. Nat Cell Biol. Nov. 2004; 6(11):1034-8 PMID 15516996.

Filppula, S.A., Yagi, A.I., Kilpelainen, S.H., Novikov, D., FitzPatrick, D.R., Vihinen, M., Valle, D. and Hiltunen, J.K. Delta3,5-delta2,4-dienoyl-CoA isomerase from rat liver. Molecular characterization, J. Biol. Chem. 273 (1), 349-355 (1998) PMID 9417087.

Forni et al., Helper strategy in tumor immunology: Expansion of helper lymphocytes and utilization of helper lymphokines for experimental and clinical immunotherapy. Cancer and Met. Reviews 7:289-309 (1988).

Gallo, K.A., Mark, M.R., Scadden, D.T., Wang, Z., Gu, Q. and Godowski, P.J. Identification and characterization of SPRK, a novel src-homology 3 domain-containing proline-rich kinase with serine/threonine kinase activity. J. Biol. Chem. 269 (21), 15092-15100 (1994).

Gansbacher et al., Retroviral Vector-mediated gamma interferon Gene Transfer into Tumor Cells Generates Potent and Long Lasting Antitumor Immunity, Cancer Res. 50: 7820-7825 (1990).

Gansbacher, B. et al., Interleukin 2 Gene Transfer into Tumor Cells Abrogates Tumorigenicity and Induces Protective Immunity. J. Exp. Med. 172:1217-1224, 1990.

Gardiner, K., Slavov, D., Bechtel, L. and Davisson, M. Annotation of human chromosome 21 for relevance to Down syndrome: gene structure and expression analysis. Genomics 79 (6), 833-843 (2002).

Gasson et al. Molecular Physiology of Granulocyte-Macrophage Colony-Stimulating Factor. Blood Mar. 15, 1991;77(6):1131-45.

Giger, R.J., Urquhart, E.R., Gillespie, S.K., Levengood, D.V., Ginty, D.D. and Kolodkin, A.L., Neuropilin-2 is a receptor for semaphorin IV: insight into the structural basis of receptor function and specificity, Neuron 21 (5), 1079-1092 (1998).

Gilles, A.M., Presecan, E., Vonica, A. and Lascu, I. Nucleoside diphosphate kinase from human erythrocytes. Structural characterization of the two polypeptide chains responsible for heterogeneity of the hexameric enzyme. J. Biol. Chem. 266 (14), 8784-8789 (1991) PMID 1851158.

Golumbeck PT et al., Treatment of Established Renal Cancer by Tumor Cells Engineerd to Secrete Interleukin-4. Science 254:713-716, 1991.

Gonzatti-Haces, M., Seth, A., Park, M., Copeland, T., Oroszlan, S. and Vande Woude, G.F. Characterization of the TPR-MET oncogene p65 and the MET protooncogene p140 protein-tyrosine kinases Proc. Natl. Acad, Sci. U.S.A. 85 (1), 21-25 (1988) PMID 3277171.

Granneman, S., Gallagher, J.E., Vogelzangs, J., Horstman, W., van Venrooij, W.J., Baserga, S.J. and Pruijn, G.J. The human Imp3 and Imp4 proteins form a ternary complex with hMpp10, which only interacts with the U3 snoRNA in 60-80S ribonucleoprotein complexes. Nucleic Acids Res. 31 (7), 1877-1887 (2003) PMID 12655004.

Guo, D., Hu, K., Lei, Y., Wang, Y., Ma, T. and He, D. Identification and characterization of a novel cytoplasm protein ICF45 that is involved in cell cycle regulation J. Biol. Chem. 279 (51), 53498-53505 (2004) PMID 15459185.

Halabi, et al. Prognostic model for predicting survival in men with HRPC: Journal of Clinical Oncology, 2003; 21(7);1232-7.

Hammond, P.W., Alpin, J., Rise, C.E., Wright, M. and Kreider, B.L. In vitro selection and characterization of Bcl-X(L)-binding proteins from a mix of tissue-specific mRNA display libraries, J. Biol. Chem. 276 (24), 20898-20906 (2001) PMID 11283018.

Harrington, J.J., Sherf, B., Rundlett, S., Jackson, P.D., Perry, R., Cain, S., et al. Creation of genome-wide protein expression libraries using random activation of gene expression. Nat. Biotechnol. 19 (5), 440-445 (2001) PMID 11329013.

Hartmann, E., Gorlich, D., Kostka, S., Otto, A., Kraft, R., Knespel, S., Burger, E., Rapoport, T.A. and Prehn, S. A tetrameric complex of membrane proteins in the endoplasmic reticulum. Eur. J. Biochem. 214 (2), 375-381 (1993).

Hase, M.E. and Cordes, V.C. Direct interaction with nup153 mediates binding of Tpr to the periphery of the nuclear pore complex Mol. Biol. Cell 14 (5), 1923-1940 (2003) PMID 12802065.

Hiromasa, Y., Fujisawa, T., Aso, Y. and Roche, T.E. Organization of the cores of the mammalian pyruvate dehydrogenase complex formed by E2 and E2 plus the E3-binding protein and their capacities to bind the E1 and E3 components. J. Biol. Chem. 279 (8), 6921-6933 (2004) PMID 14638692.

Hjelmqvist, E., Tuson, M., Marfany, G., Herrero, E., Balcells, S. and Gonzalez-Duarte, R. ORMDL proteins are a conserved new family of endoplasmic reticulum membrane proteins. Genome Biol. 3 (6), RESEARCH0027 (2002) PMID 12093374.

Hock, H. et al, Interleukin 7 Induces CD4+ T Cell-dependent Tumor Rejection. J. Exp, Med. 174:1291-1298, 1991.

Hom et al., Common Expression of Melanoma Tumor-Associated Antigens Recognized by Human Tumor Infiltrating Lymphocytes: Analysis by Human Lymphocyte Antigen Restriction, J. Immunother., 10, 153-164 (1991).

Huang, R., Xing, Z., Luan, Z., Wu, T., Wu, X., Hu, G. A specific splicing variant of SVH, a novel human armadillo repeal protein, is up-regulated in hepatocellular carcinomas, Cancer Res. Jul. 1, 2003;63(13):3775-82.

Huebner K. et al., The Human Gene Encoding GM-CSF 1s at 5q21-q32, the Chromosome Region Deleted in the 5q- Anomaly. Science 230(4731):1282-5,1985.

Imai, Y., Nakada, A., Hashida, R., Sugita, Y., Tanaka, T., Tsujimoto, G., Matsumoto, K., Aksawa, A., Saito, H. and Oshida, T. Cloning and characterization of the highly expressed ETEA gene from blood cells of atopic dermatitis patients. Biochem. Biophys. Res. Commun. 297 (5), 1282-1290 (2002) PMID 12372427.

Inuzuka, M., Hayakawa, M., Ingi, T. SERINC, an activity-regulated protein family, incorporates serine into membrane lipid synthesis. J Biol Chem. Oct. 21, 2005;280(42)35776-83.

Jaffee, et al. Novel Allogeneic Granulocyte-Macrophage Colony-Stimulating Factor-Secreting Tumor Vaccine for Pancreatic Cancer: A Phase I Trial of Safety and Immune Activation, J. Clin Oncol 2001; 19:145-156.

Jantzen, H.M., Admon, A., Bell, S.P. and Tjian, R. Nucleolar transcription factor hUBF contains a DNA-binding motif with homology to HMG proteins. Nature 344 (6269), 830-836 (1990) PMID 2330041.

Jindal, S., Dudani, A.K., Singh, B., Harley, C.B. and Gupta, R.S. Primary structure of a human mitochondrial protein homologous to the bacterial and plant chaperonins and to the 65-kilodalton mycobacterial antigen Mol. Cell. Biol. 9 (5), 2279-2283 (1989) PMID2568584.

Kalies, K.U. and Hartmann, E. Membrane topology of the 12- and the 25-kDa subunits of the mammalian signal peptidase complex. J. Biol. Chem. 271 (7), 3925-3929 (1996).

Kamakaka, R.T., Rine, J. Sir- and silencer-independent disruption of silencing in Saccharomyces by Sas10p. Genetics. Jun. 1998; 149(2):903-14 PMID 96112.

Kang, J.H., Hong, M.L., Kim, D.W., Park, J., Kang, T.C., Won, M. H., Baek, N.I., Moon, B.J., Choi, S. Y., Kwon, O.S. Genomic organization, tissue distribution and deletion mutation of human pyridoxine 5'-phosphate oxidase. Eur J Biochem. Jun. 2004;271(12):2452-61 PMID 15182361.

Kawakami et al., Shared Human Melanoma Antigens: Recognition by Tumor-Infiltrating Lymphocytes in HLA-A2.1-Transfected Melanomas. J. Immunol., 148, 638-643 (1992).

Klein et al., Properties of the K562 Cell Line, Derived from a Patient with Chronic Myeloid Leukemia. Int. J. Cancer 18; 421-431 (1976).

Koc, E.C., Burkhart, W., Blackburn, K., Moyer, M.B., Schlatzer, D.M., Moseley, A. and Sprermulli, L.L. The large subunit of the mammalian mitochondrial ribosome. Analysis of the complement of ribosomal proteins present. J. Biol. Chem. 276 (47), 43958-43969 (2001) PMID 11551941.

Kondo, H., Rabouille, C., Newman, R., Levine, T.P., Pappin, D., Freemont, P., Warren, G. p47 is a cofactor for p97-mediated membrane fusion. Nature, Jul. 3, 1997;388(6637):75-8 PMID 9214505.

Krangel, M.S., Band, H., Hata, S., McLean, J. and Brenner, M.B. Structurally divergent human T cell receptor gamma proteins encoded by distinct C gamma genes. Science 237 (4810), 64-67 (1987).

Kreft, S.G., Wang, L. and Hochstrasser, M. Membrane topology of the yeast endoplasmic reticulum-localized ubiquitin ligase Doa10 and comparison with its human ortholog TEB4 (MARCH-VI). J. Biol. Chem. 281 (8), 4646-4653 (2006) PMID 16373356.

Krull, S., Thyberg, J., Bjorkroth, B., Rackwitz, H.R. and Cordes, V.C. Nucleoporins as components of the nuclear pore complex core structure and Tpr as the architectural element of the nuclear basket Mol. Biol. Cell 15 (9), 4261-4277 (2004) PMID15229283.

Kubota, H., Hynes, G., Carne, A., Ashworth, A. and Willison, K. identification of six Tcp-1-related genes encoding divergent subunits of the TCP-1-containing chaperonin. Curr. Biol. 4 (2), 89-99 (1994).

Kume, A., Koyata, H., Sakakibara, T., Ishiguro, Y., Kure, S., Hiraga, K, The glycine cleavage system. Molecular cloning of the chicken and human glycine decarboxylase cDNAs and some characteristics involved in the deduced protein structures, J. Biol. Chem. 266 (5), 3323-3329 (1991).

Kurochkin, I.V., Yonemitsu, N., Funahashi, S. I., Nomura, H. ALEX1, a novel human armadillo repeat protein that is expressed differentially in normal tissues and carcinomas. Biochem. Biophys. Res Commun., 280: 340-347, 2001.

Kurschner, C., Mermelstein, P.G., Holden, W.T. and Surmeier, D.J. CIPP, a novel multivalent PDZ domain protein, selectively interacts with Kir4.0 family members, NMDA receptor subunits, neurexins, and neuroligins Mol. Cell. Neurosci. 11 (3), 161-172 (1998) PMID 964769.

Lee C T et al., Genetic Immunotherapy of Established Tumors with Adenovirus-Murine Granulocyte-Macrophage Colony-Stimulating Factor. Human Gene Therapy 8187-193, 1997.

Lehner, B. and Sanderson, C.M. A protein interaction framework for human mRNA degradation. Genome Res. 14(7), 1315-1323 (2004) PMID 15231747.

Lerman, M.I. and Minna, J.D. The 630-kb lung cancer homozygous deletion region on human chromosome 3p21.3: identification and evaluation of the resident candidate tumor suppressor genes. The International Lung Cancer Chromosome 3p21.3 Tumor Suppressor Gene Consortium. Cancer Res. 60 (21), 6116-6133 (2000).

Leung, E., Print, C., Parry, D. Closhy, D., Lockhard, P., Skinner, S., Batchelor, D., Krissansen GW. Cloning of novel kinectin splice variants with alternative C-termini: structure, distribution and evolution of mouse kinectin. Immunol Cell Biol. Oct. 1996;74(5);421-33.

Li, S., Okamoto, T. Chun, M., Sargiacomo, M., Casanova, J.E., Hansen, S.H., Nishimoto, I. and Lisanti, M.P. Evidence for a regulated interaction between heterotrimeric G proteins and caveolin. J. Biol. Chem. 270 (26), 15693-15701 (1995).

Liao, H., Winkfein, R.J., Mack, G., Rattner, J.B. and Yen, T.J. CENP-F is a protein of the nuclear matrix that assembles onto kinetochores at late G2 and is rapidly degraded after mitosis. J. Cell Biol. 130 (3), 507-518 (1995) PMID 7542657.

Lilley, B.N. and Ploegh, H. L. Multiprotein complexes that link dislocation, ubiquitination, and extraction of misfolded proteins from the endoplasmic reticulum membrane. Proc. Natl. Acad. Sci. U.S.A. 102 (40), 14296-14301 (2005).

Linstedt, A.D. and Hauri, H.P. Giantin, a novel conserved Golgi membrane protein containing a cytoplasmic domain of at least 350 kDa. Mol. Biol. Cell 4(7), 679-693 (1993) PMID 7691276.

Liou, A.K. and Willison, K.R. Elucidation of the subunit orientation in CCT (chaperonin containing TCP1) from the subunit composition of CCT5 micro-complexes. EMBO J. 16(14), 4311-4316 (1997) PMID 9250675.

Little, A.M., Madrigal, J.A., Parham, P. Molecular definition of an elusive third HLA-A9 molecule: HLA-A9.3. Immunogenetics, 1992;35(1):41-5 PMID 1729171.

Liu, J., Chang, C.C., Westover, E.J., Covey, D.F. and Chang, T.Y. Investigating the allosterism at acyl-CoA:cholesterol acyltransferase (ACAT) by using various sterols: in vitro and intact cell studies Biochem. J. 391 (PT 2), 389-397 (2005) PMID 159923.

Lo, S.C. and Hannink, M. PGAM5, a Bcl-XL-interacting Protein, Is a Novel Substrate for the Redox-regulated Keap1-dependent Ubiquitin Ligase Complex. J. Biol. Chem. 281 (49), 37893-37903 (2006) PMID 17046835.

Lozzio et al., Human Chronic Myelogenous Leukemia Cell-Line With Positive Philadelphia Chromosome. Blood 45(3): 321-334 (1975) Klein et al., Int. J. Cancer 18: 421-431 (1976).

Mach and Dranoff, Cytokine-secreting Tumor Cell Vaccines. Curr Opin Immunol. Oct. 2000; 12(5):571-5.

Mach et al. Differences in Dendritic Cells Stimulated in vivo by Tumors Engineered to Secrete Granulocyte-Macrophage Colony-Stimulating Factor or Flt3-Ligand. Cancer Res. Jun. 15, 2000;60(12)3239-46.

Maeda, H., Nagata, S., Wolfgang, C.D., Bratthauer, G.L., Bera, T.K. and Pastan, I, The T cell receptor gamma chain alternate reading frame protein (TARP), a prostate-specific protein localized in mitochondria. J. Biol. Chem. 279 (23), 24561-24568 (2004).

Mao, S., Neale, G.A. and Goorha, R.M. T-cell oncogene rhombotin-2 interacts with retinoblastoma-binding protein 2. Oncogene 14 (13), 1531-1539 (1997) PMID 9129143.

McNeel, D.G., Nguyen, L.D., Storer, B.E., Vessella, R., Lange, P.H., Disis, M.L. Antibody immunity to prostate cancer associated antigens can be detected in the serum of patients with prostate cancer. J Urol. Nov. 2000;164(5):1825-9.

McNeil, H.P., Simpson, R.J., Chesterman, C.N., Krilis, S.A. Antiphospholipid antibodies are directed against a complex antigen that includes a lipid-binding inhibitor of coagulation: beta 2-glycoprotein 1 (apolipoprotein H). Proc. Natl. Acad. Sci, U.S.A. 87 (11): 4120 (1990).

Methot, N., Rom, E., Olsen, H. and Sonenberg, N. The human homologue of the yeast Prt1 protein is an integral part of the eukaryotic initiation factor 3 complex and interacts with p170 J. Biol. Chem. 272 (2), 1110-1116 (1997) PMID 8995410.

Meyer, H.H., Kondo, H., Warren, G. The p47 co-factor regulates the ATPase activity of the membrane fusion protein, p97. FEBS Lett. Oct. 23, 1998;437(3):255-7 PMID 9824302.

Michel, D., Arsanto, J.P., Massey-Harroche, D., Beclin, C., Wijnholds, J. and Le Bivic, A. PATJ connects and stabilizes apical and lateral components of tight junctions in human intestinal cells J. Cell. Sci. 118 (PT 17), 4049-4057 (2005) PMID 16129888.

Mina-Osorio, P., Soto-Cruz, I. and Ortega, E. A role for galectin-3 in CD13-mediated homotypic aggregation of monocytes Biochem. Biophys. Res. Commun. 353 (3), 605-610 (2007).

Nagai, E. et al., Irradiated tumor cells adenovirally engineered to secrete granulocye/macrophage-colony-stimulating factor establish antitumor immunity and eliminate pre-existing tumors in syngeneic mice. Cancer Immunol. Immunother. 47:72-80, 1998.

Needleman & Wunsch, A General Method Applicable to the Search for Similarities in the Amino Acid Sequence of Two Proteins. J. Mol. Biol. 48: 443-453 (1970).

Nemunaitis et al., Granulocyte-Macrophage Colony-Stimulating Factor Gene-Modified Autologous Tumor Vaccines in Non-Small-Cell Lung Cancer. J Natl Cancer Inst. Feb. 18, 2004 96(4):326-31.

Ngo, E.O., LePage, G.R., Thanassi, J.W., Meisler, N., Nutter, L.M. Absence of pyridoxine-5-'-phosphate oxidase (PNPO) activity in neoplastic cells: isolation, characterization, and expression of PNPO cDNA. Biochemistry. May 26, 1998;37(21):7741-8 PMID 9601034.

N'Guyen, C., Sodoyer, R., Trucy, J., Strachan, T., Jordan, B.R. The HLA-A W24 gene: sequence, surroundings and comparison with the HLA-A2 and HLA-A3 genes. Immunogenetics. 1985;21(5):479-89 PMID 2987115.

Oettgen et al., The History of Cancer Immunotherapy, Biologic Therapy of Cancer, Chap, 6, pp. 87-119 (1991).

Ohtsuka et al., An Alternative Approach to Deoxyoligonucleotides as Hybridization Probes by Insertion of Deoxyinosine at Ambiguous Codon Positions. J. Biol. Chem. 260: 2605-2608 (1985).

Padovani, D., Labunska, T. and Banerjee, R. Energetics of interaction between the G-protein chaperone, MeaB, and B12-dependent methylmalonyl-CoA mutase, J. Biol. Chem. 281 (26), 17838-17844 (2006) PMID 16641088.

Pan, Q., Chathery, Y., Wu, Y., Rathore, N., Tong, R.K., Peale, F., Bagri, A., Tessier-Lavigne, M., Koch, A.W. and Watts, R.J., Neuropilin-1 binds to VEGF121 and regulates endothelial cell migration and sprouting, J. Biol. Chem. 282 (33), 24049-24056 (2007).

Pang, S. et al., Prostate Tissue Specificity of a Prostate-Specific Antigen Promoter Isolated from a Patient with Prostate Cancer. Hum Gene Ther. Nov. 1995; 6(11):1417-1426.

Pearson & Lipman, Improved Tools for Biological Sequence Comparison. Proc. Nat'l. Acad. Sci. USA 85:2444-2448 (1988).

Pelicci, P.G., Subar, M., Weiss, A., Dalla-Favera, R. and Littman, D.R. Molecular diversity of the human T-gamma constant region genes. Science 237 (4818), 1051-1055 (1987).

Peters, N.T., Rohrbach, J.A., Zalewski, B.A., Byrkett, C.M., Vaughn, J.C. RNA editing and regulation of Drosophila 4f-rnp expression by sas-10 antisense readthrough mRNA transcripts. RNA. Jun. 2003;9(6):698-710 PMID 12756328.

Pierre, P., Pepperkok, R. and Kreis, T.E. Molecular characterization of two functional domains of CLIP-170 in vivo J. Cell. Sci. 107 (PT 7), 1909-1920 (1994) PMID 7983157.

Pierre, P., Scheel, J., Rickard, J.E. and Kreis, T. E. CLIP-170 links endocytic vesicles to microtubules, Cell 70 (6), 887-900 (1992) PMID 1356075.

Player, A., Gillespie, J., Fujii, T., Fukuoka, J., Dracheva, T., Meerzaman, D., Hong, K.M., Curran, J., Attoh, G., Travis, W. and Jen, J. Identification of TDE2 gene and its expression in non-small cell lung cancer. Int. J. Cancer 107 (2), 238-243 (2003).

Pons, G., Raefsky-Estrin, C., Carothers, D.J., Pepin, R.A., Javed, A.A., Jesse, B.W., Ganapathi, M.K., Samols, D., Patel, M.S, Cloning and cDNA sequence of the dihydrolipoamide dehydrogenase component human alpha-ketoacid dehydrogenase complexes, Proc. Natl. Acad. Sci. U.S.A. 85 (5), 1422-1426 (1988).

Popowicz, G.M., Schleicher, M, Noegel, A.A., Holak, T.A. Filamins: promiscuous organizers of the cytoskeleton. Trends Biochem Sci. Jul. 2006;31(7):411-9. Epub Jun. 16, 2006 PMID 16781869.

Porgador, A., et al., Immunotherapy of Tumor Metastasis via Gene Therapy. Nat Immun. 13(2-3):113-30, 1994.

Qin, S., Qiu, W., Ehrlich, J.R., Ferdinand, A.S., Richie, J.P., O'leary, M.P., Lee, M.L., Liu, B.C. Development of a "reverse capture" autoantibody microarray for studies of antigen-autoantibody profiling. Proteomics. (6)3199-3209, 2006.

Raz, A., Carmi, P., Raz, T., Hogan, V., Mohamed, A. and Wolman, S.R. Molecular cloning and chromosomal mapping of a human galactoside-binding protein. Cancer Res. 51 (8), 2173-2178 (1991).

Reymond, A., Friedli, M., Henrichsen, C.N., Chapot, F., Deutsch, S., Ucla, C., Rossier, C., Lyle, R., Guipponi, M. and Antonarakis, S.E. From PREDs and open reading frames to cDNA isolation: revisiting the human chromosome 21 transcription map. Genomics 78 (1-2), 46-54 (2001).

Robertson SP. Molecular pathology of filamin A: diverse phenotypes, many functions. Clin Dysmorphol. Jul. 2004;13(3):123-31 PMID 15194946.

Roobol, A., Holmes, F.E., Hayes, N.V., Baines, A.J. and Carden, M.J. Cytoplasmic chaperonin complexes enter neurites developing in vitro and differ in subunit composition within single cells J. Cell Sci. 108 (PT 4), 1477-1488 (1995) PMID 7615668.

Rosengard, A.M., Krutzsch, H.C., Shearn, A., Biggs, J.R., Barker, E., Margulies, I.M., King, C.R., Liotta, L.A. and Steeg, P.S. Reduced Nm23/Awd protein in tumor metastasis and aberrant Drosophila development. Nature 342 (6246), 177-180 (1989) PMID 2509941.

Rossolini et al., Use of Deoxyinosine-containing primers vs degenerate primers for polymerase chain reactioni based on ambiguous sequence information, Mol. Cell. Probes 8: 91-98 (1994).

Sahin, U., Tureci, O., Schmitt, H., Cochlovius, B., Johannes, T., Schmits, R., Stenner, F., Luo, G., Schobert, I., Pfreundschuh, M. Human neoplasms elicit multiple specific immune responses in the autologous host. Proc Natl Acad Sci U S A. Dec. 5, 1995;92(25):11810-3.

Salgia et al., Vaccination with Irradiated Autologous Tumor Cells Engineered to Secrete Granulocyte-Macrophage Colony-Stimulating Factos Augments Antitumor Immunity in Some Patients with Metastatic Non-Small-Cell Lung Carcinoma. J Clin Oncol 2003 21:624-30.

Scharf, J.M., Endrizzi, M.G., Wetter, A., Huang, S., Thompson, T.G., Zerres, K., Dietrich, W.F., Wirth, B., Kunkel, L.M. Identification of a candidate modifying gene for spinal muscular atrophy by comparative genomics. Nat Genet. Sep. 1998;20(1):83-6 PMID 9731538.

Scherer, P.E. and Lisanti, M.P. Association of phosphofructokinase-M with caveolin-3 in differentiated skeletal myotubes. Dynamic regulation by extracellular glucose and intracellular metabolites. J. Biol. Chem. 272 (33), 20698-20705 (1997).

Schram, A.W., Goldfischer, S., van Roermund, C.W., Brouwer-Kelder, E.M., Collins, J., Hashimoto, T., Heyrnans, H.S., van den Bosch, H., Schingens, R.B., Tager, J.M, et al. Human peroxisomal 3-oxoacyl-coenzyme A thiolase deficiency. Proc. Natl. Acad. Sci. U.S.A. 84 (8), 2494-2496 (1987) PMID 2882519.

Seelig, H.P., Schranz, P., Schroter, H., Wiemann, C. and Renz, M. Macrogolgin—a new 376 kD Golgi complex outer membrane protein as target of antibodies in patients with rheumatic diseases and HIV infections. J. Autoimmun. 7 (1), 67-91 (1994) PMID 8198703.

Seko, T., Ito, M., Kureishi, Y., Okamoto, R., Moriki, N., Onishi, K., Isaka, N., Hartshorne, D.J. and Nakano, T. Activation of RhoA and inhibition of myosin phosphatase as important components in hypertension in vascular smooth muscle. Circ. Res. 92 (4), 411-418 (2003) PMID 12600888.

Silverman, J., Takai, H., Buonomo, S.B., Eisenhaber, F. and de Lange, T. Human Rif1, ortholog of a yeast telomeric protein, is regulated by ATM and 53BP1 and functions in the S-phase checkpoint. Genes Dev. 18 (17), 2108-2119 (2004) PMID 15342490.

Simons, J. W. et al., Bioactivity of Autologous Renal Cell Carcinoma Vaccines Generated by ex Vivo Granulocyte-Macrophage Colony-Stimulating Factor Gene Transfer. Cancer Res 1997; 57:1537-1546.

Simons, J. W. et al., Induction of Immunity to Prostate Cancer Antigens: Results of a Clinical Trial of Vaccination with Irradiated Autologous Prostate Tumor Cells Engineered to Secrete Granulocyte-Macrophage Colony-Stimulating Factor using ex Vivo Gene Transfer. Cancer Res. 1999; 59:5160-5168.

Simpson, J.C., Wellenreuther, R., Poustka, A., Pepperkok, R. and Wiemann, S. Systematic subcellular localization of novel proteins identified by large-scale cDNA sequencing. EMBO Rep. 1 (3), 287-292 (2000).

Smith & Waterman, Comparison of Biosequences, Adv. Appl. Math. 2:482-489 (1981).

Sohda, M., Misumi, Y., Fujiwara, T., Nishioka, M. and Ikehara, Y. Molecular cloning and sequence analysis of a human 372-kDA protein localized in the Golgi complex. Biochem. Biophys. Res. Commun. 205 (2), 1399-1408 (1994) PMID 7802676.

Soiffer et al., Molecular Cloning and Sequence Analysis of a Human 372-kDA Protein Localized in the Golgi Complex. J Clin Oncol 2003 21:3343-50.

Soiffer R et al., Vaccination with Irradiated, Autologous Melanoma Cells Engineered to Secrete Granulocyte-Macrophage Colony-Stimulating Factor by Adenoviral-Mediated Gene Transfer Augments Antitumor Immunity in Patients with Metastatic Melanoma, Proc. Natl. Acad. Sci USA 1998; 95:13141-13146.

Soker, S., Takashima, S., Miao, H.Q., Neufeld, G. and Klagsbrun, M, Neuropilin-1 is expressed by endothelial and tumor cells as an isoform-specific receptor for vascular endothelial growth factor, Cell 92 (6), 735-745 (1998).

Song, H.Y. and Donner, D.B. Association of a RING finger protein with the cytoplasmic domain of the human type-2 tumor necrosis factor receptor Biochem, J. 309 (PT 3), 825-829 (1995) PMID 7639698.

Sonnichsen, B., Lowe, M., Levine, T., Jamsa, E., Dirac-Svejstrup, B. and Warren, G. A role for giantin in docking COPI vesicles to Golgi membranes. J. Cell Biol. 140 (5), 1013-1021(1998) PMID 9490716.

Strausberg, R.L. et al., Mammalian Gene Collection Program Team. Generation and initial analysis of more than 15,000 full-length human and mouse cDNA sequences. Proc Natl Acad Sci U S A, Dec. 24, 2002;99(26):16899-903.

Sucishi, M., Takagi, M. and Yoneda, Y. The forkhead-associated domain of Ki-67 antigen interacts with the novel kinesin-like protein Hk1p2. J. Biol. Chem. 275 (37), 28888-28892 (2000) PMID 0878014.

Suzuki, T., Terasaki, M., Takemoto-Hori, C., Hanada, T., Ueda, T., Wada, A. and Watanabe, K. Structural compensation for the deficit of rRNA with proteins in the mammalian mitochondrial ribosome. Systematic analysis of protein components of the large ribosomal subunit from mammalian mitochondria. J. Biol. Chem. 276 (24), 21724-21736 (2001) PMID 11279069.

Takahashi, T., Nakamura, F., Jin, Z., Kalb, E.G. and Strittmatter, S,M, Semaphorins A and E act as antagonists of neuropilin-1 and agonists of neuropilin-2 receptors, Nat. Neurosci. 1 (6), 487-493 (1998).

Tang, Z., Scherer, P.E., Okamoto, T., Song, K., Chu, C., Kohtz, D.S., Nishimoto, I., Lodish, H.F. and Lisanti, M.P. Molecular cloning of caveolin-3, a novel member of the caveolin gene family expressed predominantly in muscle. J. Biol. Chem. 271 (4), 2255-2261 (1996).

Tassi, E., Biesova, Z., Di Fiore, P.P., Gutkind, J.S. and Wong, W.T. Human JIK, a novel member of the STE20 kinase family that inhibits JNK and is negatively regulated by epidermal growth factor J. Biol. Chem. 274 (47), 33287-33295 (1999) PMID 10559204.

Teng, M. et al., Long-term Inhibition of Tumor Growth by Tumor Necrosis Factor in the Absence of Cachexia or T-cell Immunity. PNAS 88:3535-3539, 1991.

Thomas et al., Mesothelin-specific CD8+ T Cell Responses Provide Evidence of in vivo Cross-Priming by Antigen-Presenting Cells in Vaccinated Pancreatic Cancer Patients. J. Exp. Med. 200(3)297-306, 2004.

Tijssen, P. (1993) Laboratory Techniques in Biochemistry and Molecular Biology—Hybridization with Nucleic Acid Probes part 1 chapter 2 "Overview of principles of hybridization and the strategy of nucleic acid probe assays" Elsevier, New York.

Townsley, F.M., Aristarkhov, A., Beck, S., Hershko, A. and Ruderman, J.V. Dominant-negative cyclin-selective ubiquitin carrier protein E2-C/UbcH10 blocks cells in metaphase. Proc. Natl. Acad. Sci. U.S.A. 94 (6), 2362-2367 (1997).

Trauger, J.W., Lin, F.F., Turner, M.S., Stephens, J. and LoGrasso, P.V. Kinetic mechanism for human Rho-Kinase II (ROCK-II). Biochemistry 41 (28), 8948-8953 (2002) PMID 12102637.

Tsurumi, C., Shimizu, Y., Saeki, M., Kato, S., Demartino, G.N., Slaughter, C.A., Fujimuro, M., Yokosawa, H., Yamasaki, M., Hendil, K.B., Toh-e, A., Tanahashi, N. and Tanaka, K. cDNA cloning and functional analysis of the p97 subunit of the 26S proteasome, a polypeptide identical to the type-1 tumor-necrosis-factor-receptor-associated protein-2/55.11 Eur. J. Biochem. 239 (3), 912-921 (1996) PMID 8774743.

Twells, R. C. J.; Metzker, M. L.; Brown, S. D.; Cox, R.; Garey, C.; Hammond, H.; Hey, P.J.; Levy, E.; Nakagawa, Y.; Philips, M. S.; Todd, J, A.; Hess, J. F, The sequence and gene characterization of a 400-kb candidate region for IDDM4 on chromosome 11q13, Genomics 72: 231-242, 2001.

Usui, H., Morii, K., Tanaka, R., Tamura, T., Washiyama, K., Ichikawa, T. and Kumanishi, T. cDNA cloning and mRNA expression analysis of the human neuronatin. High level expression in human pituitary gland and pituitary adenomas. J. Mol. Neurosci. 9 (1), 55-60 (1997) PMID 9356927.

Vaccaro, P., Brannan, B., Montecchi-Palazzi, L., Philipp, S., Helmer Citterich, M., Cesareni, G. and Dente, L. Distinct binding specificity of the multiple PDZ domains of INADL, a human protein with homology to INAD from Drosophila melanogaster J. Biol. Chem. 276 (45), 42122-42130 (2001).

Valdmanis, P.N., Meijer, I.A., Reynolds, A., Lei, A., Macleod, P., Schlesinger, D., Zatz, M., Reid, E., Dion, P.A., Drapeau, P., Rouleau, G.A. Mutations in the KIAA0196 Gene at the SPG8 Locus Cause Hereditary Spastic Paraplegia. Am J Hum Genet. Jan. 2007;80(1):152-61. Epub Dec. 1, 2006 PMID 17160902.

Valentin, H., Gelin, C., Coulombel, L., Zoccola, D., Morizet, J. and Bernard, A. The distribution of the CDW52 molecule on blood cells and characterization of its involvement in T cell activation. Transplantation 54 (1), 97-104 (1992) PMID 1352921.

Varambally, S., Yu, J., Laxman, B., Rhodes, D.R., Mehra, R., Tomlins, S.A., Shah, R.B., Chandran, U., Monzon, F.A., Becich, M.J., Wei, J.T., Pienta, K.J., Ghosh, D., Rubin, M.A., Chinnaiyan, A.M. Integrative genomic and proteomic analysis of prostate cancer reveals signatures of metastatic progression. Cancer Cell. Nov. 2005;8(5):393-406.

Venner, T.J., Singh, B. and Gupta, R.S. Nucleotide sequences and novel structural features of human and Chinese hamster hsp60 (chaperonin) gene families DNA Cell Biol. 9 (8), 545-552 (1990) PMID 1980192.

Voit, R., Kuhn, A., Sander, E.E. and Grummt, I. Activation of mammalian ribosomal gene transcription requires phosphorylation of the nucleolar transcription factor UBF. Nucleic Acids Res. 23 (14), 2593-2599 (1995) PMID 7651819.

Wang, L. and Dobberstein, B. Oligomeric complexes involved in translocation of proteins across the membrane of the endoplasmic reticulum. FEBS Lett. 457 (3), 316-322 (1999).

Wang, X., Yu, J., Sreekumar, A., Varambally, S., Shen, R., Giacherio, D., Mehra, R., Montie, J.E., Pienta, K.J., Sanda, M.G., Kantoff, P.W., Rubin, M.A., Wei, J.T., Ghosh, D., Chinnaiyan, A.M. Autoantibody signatures in prostate cancer. N Engl J Med. Sep. 22, 2005;353(12):1224-35.

Watanabe, T., Masuyama, J., Sohma, Y., Inazawa, H., Horie, K., Kojima, K., Uemura, Y., Aoki, Y., Kaga, S., Minota, S., Tanaka, T., Yamaguchi, Y., Kobayashi, T. and Serizawa, I. CD52 is a novel costimulatory molecule for induction of CD4+ regulatory T cells. Clin. Immunol. 120 (3), 247-259 (2006) PMID 16797237.

Westendorf, J.M., Konstantinov, K.N., Wormsley, S., Shu, M.D., Matsumoto-Taniura, N., Pirollet, F., Klier, F.G., Gerace, L. and Baserga, S.J. M phase phosphoprotein 10 is a human U3 small nucleolar ribonucleoprotein component. Mol. Biol. Cell 9 (2), 437-449 (1998) PMID 9450966.

Witke W., Podtelejnikov, A.V., Di Nardo, A., Sutherland, J.D., Gurniak, C.B., Dotti, C. and Mann, M. In mouse brain profilin I and profilin II associate with regulators of the endocytic pathway and actin assembly. EMBO J. 17 (4), 967-976 (1998) PMID 9463375.

Wong, E.V., Schaefer, A.W., Landreth, G. and Lemmon, V. Involvement of p90rsk in neurite outgrowth mediated by the cell adhesion molecule L1. J. Biol. Chem. 271 (30), 18217-18223 (1996).

Xing, J., Ginty, D.D. and Greenberg, M.E. Coupling of the RAS-MAPK pathway to gene activation by RSK2, a growth factor-regulated CREB kinase. Science 273 (5277), 959-963 (1996).

Xu, L. and Blackburn, E.H. flutnan Rif1 protein binds aberrant telomeres and aligns along anaphase midzone microtubules. J. Cell Biol. 167 (5), 819-830 (2004) PMID 15583028.

Ye, Y., Meyer, H.H., Rapoport, T.A. The AAA ATPase Cdc48/p97 and its partners transport proteins from the ER into the cytosol. Nature. Dec. 6, 2001;414(6864):652-6 PMID 11740563.

Ye, Y., Shibata, Y., Kikkert, M., van Voorden, S., Wiertz, E. and Rapoport, T.A. Inaugural Article: Recruitment of the p97 ATPase and ubiquitin ligases to the site of retrotranslocation at the endoplasmic reticulum membrane. Proc. Natl. Acad. Sci. U.S.A. 102 (40), 14132-14138 (2005).

Yu, L.G., Andrews, N., Zhao, Q., McKean, D., Williams, J.F., Connor, L.J., Gerasimenko, O.V., Hilkens, J., Hirabayashi, J., Kasai, K. and Rhodes, J.M. Galectin-3 interaction with Thomsen-Friedenreich disaccharide on cancer-associated MUC1 causes increased cancer cell endothelial adhesion. J. Biol. Chem. 282 (1), 773-781 (2007).

Zanin-Zhorov, A., Cahalon, L., Tal, G., Margalit, R., Lider, O. and Cohen, I.R. Heat shock protein 60 enhances CD4+ CD25+ regulatory T cell function via innate TLR2 signaling J. Clin. Invest. 116 (7), 2022-2032 (2006) PMID 16767222.

Zhang, W., Chen, T., Wan, T., He, L., Li, N., Yuan, Z. and Cao, X. Cloning of DPK, a novel dendritic cell-derived protein kinase activating the ERK1/ERK2 and JNK/SAPK pathways. Biochem. Biophys. Res. Commun. 274 (3), 872-879 (2000) PMID 10924369.

Zhao, Y., Bjorbaek, C., Weremowicz, S., Morton, C.C. and Moller, D.E. RSK3 encodes a novel pp90rsk isoform with a unique N-terminal sequence: growth factor-stimulated kinase function and nuclear translocation. Mol. Cell. Biol. 15 (8), 4353-4363 (1995).

ISA/US International Search Report dated Aug. 13, 2008, for International Patent Application No. PCT/US2008/002788, filed Mar. 3, 2008.

Nelson et al., "Cancer Cells Engineered to Secrete Granulocyte-Macrophage Colony-Stimulating Factor Using Ex Vivo Gene Transfer as Vaccines for the Treatment of Genitourinary malignancies," Cancer Chemotherapy Pharmacology (2000), vol. 46(Suppl): S67-S72.

Small et al., "Granulocyte Macrophage Colony-Stimulating Factor-Secreting Allogeneic Cellular Immunotherapy for Hormone-Refractory Prostate Cancer," Clinical Cancer Research (2007), vol. 13(13):3883-3891.

EPO, Communication and Supplementary European Search Report dated Jan. 29, 2010 for European patent application No. 08 72 6245.

Harding et al., "Humoral immune response induced to filamin B in patients with metastatic hormone-refractory prostate cancer (HRPC) treated with a GM-CSF-transduced allogeneic prostate cancer vaccine (GVAX(R))," Proceeding s of the Annual Meeting of the American Association for Cancer Research, vol. 47th, (2006), p. 680, XP001536969.

Hege et al., "Identification of antibody responses induced in patients with biochemically recurrent and castration-resistant prostate cancer receiving GVAX immunotherapy of prostate cancer," Cancer Immunity, vol. 8, (2008), p. 24, XP002565784.

* cited by examiner

METHODS AND COMPOSITIONS FOR IDENTIFYING PROSTATE CANCER OR A HUMORAL IMMUNE RESPONSE AGAINST PROSTATE CANCER

1. PRIOR RELATED APPLICATIONS

This application claims the benefit under 35 U.S.C. §119(e) of U.S. Provisional Application No. 60/904,688, filed Mar. 2, 2007, and U.S. Provisional Application No. 60/978,029, filed Oct. 5, 2007, which are incorporated herein by reference in their entirety.

2. FIELD OF THE INVENTION

The present invention relates to prostate cancer markers, compositions comprising such markers, immunoglobulins specific for such markers, and methods of using such markers and/or immunoglobulins to assess an immune response against prostate cancer. An immune response against the markers correlates with an immune response, in particular a humoral immune response, against prostate cancer cells which immune response is preferably associated with prophylaxis of prostate cancer, treatment of prostate cancer, and/or amelioration of at least one symptom associated with prostate cancer.

3. BACKGROUND

The immune system plays a critical role in the pathogenesis of a wide variety of cancers. When cancers progress, it is widely believed that the immune system either fails to respond sufficiently or fails to respond appropriately, allowing cancer cells to grow. Currently, standard medical treatments for cancer including chemotherapy, surgery, radiation therapy and cellular therapy have clear limitations with regard to both efficacy and toxicity. To date, these approaches have met with varying degrees of success dependent upon the type of cancer, general health of the patient, stage of disease at the time of diagnosis, etc. Improved strategies that combine specific manipulation of the immune response to cancer in combination with standard medical treatments may provide a means for enhanced efficacy and decreased toxicity.

One therapeutic approach to cancer treatment involves the use of genetically modified tumor cells which express cytokines locally at the vaccine site. Activity has been demonstrated in tumor models using a variety of immunomodulatory cytokines, including IL-4, IL-2, TNF-alpha, G-CSF, IL-7, IL-6 and GM-CSF, as described in Golumbeck P T et al., Science 254:13-716, 1991; Gansbacher B et al., J. Exp. Med. 172:1217-1224, 1990; Fearon E R et al., Cell 60:397-403, 1990; Gansbacher B et al., Cancer Res. 50:7820-25, 1990; Teng M et al., PNAS 88:3535-3539, 1991; Columbo M P et al., J. Exp. Med. 174:1291-1298, 1991; Aoki et al., Proc Natl Acad Sci USA. 89(9):3850-4, 1992; Porgador A, et al., Nat. Immun. 13(2-3):113-30, 1994; Dranoff G et al., PNAS 90:3539-3543, 1993; Lee C T et al., Human Gene Therapy 8:187-193, 1997; Nagai E et al., Cancer Immunol. Immunother. 47:2-80, 1998 and Chang A et al., Human Gene Therapy 11:839-850, 2000, respectively. The use of autologous cancer cells as vaccines to augment anti-tumor immunity has been explored for some time. See, e.g., Oettgen et al., "The History of Cancer Immunotherapy", In: Biologic Therapy of Cancer, Devita et al. (eds.) J. Lippincot Co., pp 87-199, 1991; Armstrong T D and Jaffee E M, Surg Oncol Clin N Am. 11(3):681-96, 2002; and Bodey B et al., Anticancer Res 20(4):2665-76, 2000).

Several phase I/II human trials using GM-CSF-secreting autologous or allogeneic tumor cell vaccines have been performed (Simons et al. Cancer Res 1999 59:5160-8; Soiffer et al. Proc Natl Acad Sci USA 1998 95:13141-6; Simons et al. Cancer Res 1997 57:1537-46; Jaffee et al. J Clin Oncol 2001 19:145-56; Salgia et al. Clin Oncol 2003 21:624-30; Soiffer et al. J Clin Oncol 2003 21:3343-50; Nemunaitis et al. J Natl Cancer Inst. 2004 Feb. 18 96(4):326-31; Borello and Pardoll, Growth Factor Rev. 13(2):185-93, 2002; and Thomas et al., J. Exp. Med. 200(3)297-306, 2004).

Administration of genetically modified GM-CSF-expressing cancer cells to a patient results in an immune response and preliminary clinical efficacy against prostate and other cancers has been demonstrated in Phase I/II clinical trails. However, there remains a need for improved methods and compositions for predicting whether such therapies are likely to be effective, for monitoring the effectiveness of such therapies, and for increasing the effectiveness of such therapies. These and other needs are provided by the present invention.

4. SUMMARY

The present invention provides prostate cancer markers, compositions comprising such markers, immunoglobulins specific for such markers, and methods of using such markers and/or immunoglobulins to assess an immune response against prostate cancer. An immune response against the markers correlates with an immune response, in particular a humoral immune response, against prostate cancer cells which immune response is preferably associated with prophylaxis of prostate cancer, treatment of prostate cancer, and/or amelioration of at least one symptom associated with prostate cancer.

Thus, in a first aspect, the invention provides a method for identifying whether a subject is afflicted with prostate cancer, comprising detecting an immune response against an antigen identified in Table 1, 2, 3, 4, 7 or 9, wherein detection of the immune response indicates that the subject is afflicted with prostate cancer.

In certain embodiments, the subject is a mammal. In certain embodiments, the subject is a human. In certain embodiments, the immune response is a humoral immune response. In certain embodiments, the immune response is a cellular immune response.

In certain embodiments, an immune response is detected against an antigen identified in Table 1. In certain embodiments, an immune response is detected against an antigen identified in Table 2. In certain embodiments, an immune response is detected against an antigen identified in Table 3. In certain embodiments, an immune response is detected against an antigen identified in Table 4. In certain embodiments, an immune response is detected against an antigen identified in Table 7. In certain embodiments, an immune response is detected against an antigen identified in Table 9. In certain embodiments, an immune response is detected against 2, 3, 4, 5, 6, 7, 8, 9, 10, 11, 12, 13, 14, or 15 of the antigens in Table 1. In certain embodiments, an immune response is detected against 2, 3, 4, 5, 6, 7, 8, 9, 10, 11, 12, 13, 14, or 15 of the antigens in Table 2. In certain embodiments, an immune response is detected against 2, 3, 4, 5, 6, 7, 8, 9, 10, 11, 12, 13, 14, or 15 of the antigens in Table 3. In certain embodiments, an immune response is detected against 2, 3, 4, 5, 6, 7, 8, 9, 10, 11, 12, 13, 14, or 15 of the antigens in Table 4. In certain embodiments, an immune response is detected against 2, 3, 4, 5, 6, 7, 8 or 9 of the antigens in Table 7. In certain embodiments, an immune response is detected against 2, 3, 4, 5, 6, 7, 8, 9, 10, 11, 12, 13, 14, or 15 of the antigens in Table 9.

In certain embodiments, an immune response is detected against HLA-A24 class I histocompatibility antigen A-24 alpha chain precursor (HLA-A24), Ubiquitin thioesterase OTUB2 (OUTB2), protein FLJ14668 (FLJ14668), neuronatin (NNAT) or cardiolipin. In certain embodiments, an immune response is detected against HLA-A24. In certain embodiments, an immune response is detected against OUTB2. In certain embodiments, an immune response is detected against FLJ14668. In certain embodiments, an immune response is detected against NNAT. In certain embodiments, an immune response is detected against cardiolipin. In certain embodiments, an immune response is detected against HLA-A24 and OUTB2. In certain embodiments, an immune response is detected against HLA-A24 or OUTB2. In certain embodiments, an immune response is detected against HLA-A24 and FLJ14668. In certain embodiments, an immune response is detected against HLA-A24 or FLJ14668. In certain embodiments, an immune response is detected against HLA-A24 and NNAT. In certain embodiments, an immune response is detected against HLA-A24 or NNAT. In certain embodiments, an immune response is detected against HLA-A24 and cardiolipin. In certain embodiments, an immune response is detected against HLA-A24 or cardiolipin. In certain embodiments, an immune response is detected against OUTB2 and FLJ14668. In certain embodiments, an immune response is detected against OUTB2 or FLJ14668. In certain embodiments, an immune response is detected against OUTB2 and NNAT. In certain embodiments, an immune response is detected against OUTB2 or NNAT. In certain embodiments, an immune response is detected against OUTB2 and cardiolipin. In certain embodiments, an immune response is detected against OUTB2 or cardiolipin. In certain embodiments, an immune response is detected against FLJ14668 and NNAT. In certain embodiments, an immune response is detected against FLJ14668 or NNAT. In certain embodiments, an immune response is detected against FLJ14668 and cardiolipin. In certain embodiments, an immune response is detected against FLJ14668 or cardiolipin. In certain embodiments, an immune response is detected against NNAT and cardiolipin. In certain embodiments, an immune response is detected against NNAT or cardiolipin. In certain embodiments, an immune response is detected against any three antigens selected from HLA-A24, OUTB2, FLJ14668, NNAT and cardiolipin.

In another aspect, the invention provides a method for determining whether a subject is likely to respond to prostate cancer therapy with a composition comprising cancer cells that have been rendered proliferation-incompetent and have been genetically engineered to express GM-CSF, comprising detecting an immune response against an antigen listed in Table 1, 2, 3, 4, 5, 6, 7 or 9, wherein detecting the immune response indicates that the subject is likely to respond to said prostate cancer therapy. In certain embodiments, the prostate cancer therapy can be other than a therapy with a composition comprising cancer cells that have been rendered proliferation-incompetent and have been genetically engineered to express GM-CSF; in such embodiments, the prostate cancer therapy can be any cancer immunotherapy known to one skilled in the art without limitation.

In certain embodiments, the subject is a mammal. In certain embodiments, the subject is a human. In certain embodiments, the cancer cells are autologous. In certain embodiments, the cancer cells are allogeneic. In certain embodiments, the cancer cells are LnCaP cells or PC3 cells.

In certain embodiments, an immune response is detected against an antigen listed in Table 1. In certain embodiments, an immune response is detected against an antigen listed in Table 2. In certain embodiments, an immune response is detected against an antigen listed in Table 3. In certain embodiments, an immune response is detected against an antigen listed in Table 4. In certain embodiments, an immune response is detected against an antigen listed in Table 5. In certain embodiments, an immune response is detected against an antigen listed in Table 6. In certain embodiments, an immune response is detected against an antigen listed in Table 7. In certain embodiments, an immune response is detected against an antigen listed in Table 9. In certain embodiments, an immune response is detected against one, two, three, four, five, six, seven, eight, nine, ten, eleven, twelve, thirteen, fourteen, fifteen, or more of the antigens listed in Table 1, 2, 3, 4, 5, 6, 7 or 9.

In certain embodiments, an immune response is detected against HLA-A24, OUTB2, FLJ14668, neuronatin (NNAT) or cardiolipin. In certain embodiments, an immune response is detected against HLA-A24. In certain embodiments, an immune response is detected against OUTB2. In certain embodiments, an immune response is detected against FLJ14668. In certain embodiments, an immune response is detected against NNAT. In certain embodiments, an immune response is detected against cardiolipin. In certain embodiments, an immune response is detected against HLA-A24 and OUTB2. In certain embodiments, an immune response is detected against HLA-A24 or OUTB2. In certain embodiments, an immune response is detected against HLA-A24 and FLJ14668. In certain embodiments, an immune response is detected against HLA-A24 or FLJ14668. In certain embodiments, an immune response is detected against HLA-A24 and NNAT. In certain embodiments, an immune response is detected against HLA-A24 or NNAT. In certain embodiments, an immune response is detected against HLA-A24 and cardiolipin. In certain embodiments, an immune response is detected against HLA-A24 or cardiolipin. In certain embodiments, an immune response is detected against OUTB2 and FLJ14668. In certain embodiments, an immune response is detected against OUTB2 or FLJ14668. In certain embodiments, an immune response is detected against OUTB2 and NNAT. In certain embodiments, an immune response is detected against OUTB2 or NNAT. In certain embodiments, an immune response is detected against OUTB2 and cardiolipin. In certain embodiments, an immune response is detected against OUTB2 or cardiolipin. In certain embodiments, an immune response is detected against FLJ14668 and NNAT. In certain embodiments, an immune response is detected against FLJ14668 or NNAT. In certain embodiments, an immune response is detected against FLJ14668 and cardiolipin. In certain embodiments, an immune response is detected against FLJ14668 or cardiolipin. In certain embodiments, an immune response is detected against NNAT and cardiolipin. In certain embodiments, an immune response is detected against NNAT or cardiolipin. In certain embodiments, an immune response is detected against any three antigens selected from HLA-A24, OUTB2, FLJ14668, NNAT and cardiolipin.

In certain embodiments, responsiveness to the cancer therapy is measured by decreased serum concentrations of tumor specific markers, increased overall survival time, increased progression-free survival, decreased tumor size, decreased bone metastasis marker response, increased impact on minimal residual disease, increased induction of antibody response to the cancer cells that have been rendered proliferation-incompetent, increased induction of delayed-typehypersensitivity (DTH) response to injections of autologous tumor, increased induction of T cell response to autologous tumor or candidate tumor-associated antigens, increased impact on circulating T cell and dendritic cell numbers, phenotype, and function, cytokine response, decreased concentrations of prostate-specific antigen (PSA), reduced slope of PSA doubling time, increased PSA doubling time, reduced metastasis as measured by bone scan, increased time to progression, increased survival time as compared to the Halabi nomogram, decreased serum concentrations of ICTP, or decreased concentrations of serum C-reactive protein. See Halabi et al., 2003. J Clin Oncol 21:1232-7, for a description of the Halabi nomogram.

In certain embodiments, responsiveness to the cancer therapy is measured by decreased serum concentrations of tumor specific markers, e.g., prostate-specific antigen (PSA). In certain embodiments, responsiveness to the cancer therapy is measured by increased overall survival time. In certain embodiments, responsiveness to the cancer therapy is measured by increased progression-free survival. In certain embodiments, responsiveness to the cancer therapy is measured by decreased tumor size. In certain embodiments, responsiveness to the cancer therapy is measured by decreased bone metastasis marker response. In certain embodiments, responsiveness to the cancer therapy is measured by increased impact on minimal residual disease. In certain embodiments, responsiveness to the cancer therapy is measured by increased induction of antibody response to the cancer cells that have been rendered proliferation-incompetent. In certain embodiments, responsiveness to the cancer therapy is measured by increased induction of delayed-type-hypersensitivity (DTH) response to injections of autologous tumor. In certain embodiments, responsiveness to the cancer therapy is measured by increased induction of T cell response to autologous tumor or candidate tumor-associated antigens. In certain embodiments, wherein responsiveness to the cancer therapy is measured by increased impact on circulating T cell and dendritic cell numbers, phenotype, and function, cytokine response.

In certain embodiments, the immune response is a humoral immune response. In certain embodiments, the immune response is a cellular immune response.

In another aspect, the invention provides a computer-implemented method for determining whether a subject is likely to respond to prostate cancer therapy with a composition comprising cancer cells that have been rendered proliferation-incompetent and have been genetically engineered to express GM-CSF, comprising inputting into a computer memory data indicating whether an immune response against an antigen listed in Table 1, 2, 3, 4, 5, 6, 7 or 9 is detected, inputting into the computer memory a correlation between an immune response against an antigen listed in Table 1, 2, 3, 4, 5, 6, 7 or 9 and a likelihood of responding to said therapy, and determining whether the subject is likely to respond to said therapy.

In certain embodiments, the subject is a mammal. In certain embodiments, the subject is a human.

In certain embodiments, the cancer cells are autologous. In certain embodiments, the cancer cells are allogeneic. In certain embodiments, the cancer cells are LnCaP cells or PC3 cells.

In certain embodiments, an immune response is detected against an antigen listed in Table 1. In certain embodiments, an immune response is detected against an antigen listed in Table 2. In certain embodiments, an immune response is detected against an antigen listed in Table 3. In certain embodiments, an immune response is detected against an antigen listed in Table 4. In certain embodiments, an immune response is detected against an antigen listed in Table 5. In certain embodiments, an immune response is detected against an antigen listed in Table 6. In certain embodiments, an immune response is detected against an antigen listed in Table 7. In certain embodiments, an immune response is detected against an antigen listed in Table 9. In certain embodiments, an immune response is detected against one, two, three, four, five, six, seven, eight, nine, ten, eleven, twelve, thirteen, fourteen, fifteen, or more of the antigens listed in Table 1, 2, 3, 4, 5, 6, 7 or 9.

In certain embodiments, an immune response is detected against HLA-A24, OUTB2, FLJ14668, neuronatin (NNAT) or cardiolipin. In certain embodiments, an immune response is detected against HLA-A24. In certain embodiments, an immune response is detected against OUTB2. In certain embodiments, an immune response is detected against FLJ14668. In certain embodiments, an immune response is detected against NNAT. In certain embodiments, an immune response is detected against cardiolipin. In certain embodiments, an immune response is detected against HLA-A24 and OUTB2. In certain embodiments, an immune response is detected against HLA-A24 or OUTB2. In certain embodiments, an immune response is detected against HLA-A24 and FLJ14668. In certain embodiments, an immune response is detected against HLA-A24 or FLJ14668. In certain embodiments, an immune response is detected against HLA-A24 and NNAT. In certain embodiments, an immune response is detected against HLA-A24 or NNAT. In certain embodiments, an immune response is detected against HLA-A24 and cardiolipin. In certain embodiments, an immune response is detected against HLA-A24 or cardiolipin. In certain embodiments, an immune response is detected against OUTB2 and FLJ14668. In certain embodiments, an immune response is detected against OUTB2 or FLJ14668. In certain embodiments, an immune response is detected against OUTB2 and NNAT. In certain embodiments, an immune response is detected against OUTB2 or NNAT. In certain embodiments, an immune response is detected against OUTB2 and cardiolipin. In certain embodiments, an immune response is detected against OUTB2 or cardiolipin. In certain embodiments, an immune response is detected against FLJ14668 and NNAT. In certain embodiments, an immune response is detected against FLJ14668 or NNAT. In certain embodiments, an immune response is detected against FLJ14668 and cardiolipin. In certain embodiments, an immune response is detected against FLJ14668 or cardiolipin. In certain embodiments, an immune response is detected against NNAT and cardiolipin. In certain embodiments, an immune response is detected against NNAT or cardiolipin. In certain embodiments, an immune response is detected against any three antigens selected from HLA-A24, OUTB2, FLJ14668, NNAT and cardiolipin.

In certain embodiments, responsiveness to the cancer therapy is measured by decreased serum concentrations of tumor specific markers, increased overall survival time, increased progression-free survival, decreased tumor size, decreased bone metastasis marker response, increased impact on minimal residual disease, increased induction of antibody response to the cancer cells that have been rendered proliferation-incompetent, increased induction of delayed-type-hypersensitivity (DTH) response to injections of autologous tumor, increased induction of T cell response to autologous tumor or candidate tumor-associated antigens, increased impact on circulating T cell and dendritic cell numbers, phenotype, and function, cytokine response, decreased concentrations of prostate-specific antigen (PSA), reduced slope of PSA doubling time, increased PSA doubling time, reduced metastasis as measured by bone scan, increased time to progression, increased survival time as compared to the Halabi nomogram, decreased serum concentrations of ICTP, or decreased concentrations of serum C-reactive protein.

In certain embodiments, responsiveness to the cancer therapy is measured by decreased serum concentrations of tumor specific markers. In certain embodiments, responsiveness to the cancer therapy is measured by increased overall survival time. In certain embodiments, responsiveness to the cancer therapy is measured by increased progression-free survival. In certain embodiments, responsiveness to the cancer therapy is measured by decreased tumor size. In certain embodiments, responsiveness to the cancer therapy is measured by decreased bone metastasis marker response. In certain embodiments, responsiveness to the cancer therapy is measured by increased impact on minimal residual disease. In certain embodiments, responsiveness to the cancer therapy is measured by increased induction of antibody response to the cancer cells that have been rendered proliferation-incompetent. In certain embodiments, responsiveness to the cancer therapy is measured by increased induction of delayed-type-hypersensitivity (DTH) response to injections of autologous tumor. In certain embodiments, responsiveness to the cancer therapy is measured by increased induction of T cell response to autologous tumor or candidate tumor-associated antigens. In certain embodiments, responsiveness to the cancer therapy is measured by increased impact on circulating T cell and dendritic cell numbers, phenotype, and function, cytokine response.

In certain embodiments, the immune response is a humoral immune response. In certain embodiments, the immune response is a cellular immune response.

In another aspect, the invention provides a method for determining whether a subject is responding to prostate cancer therapy with a composition comprising cancer cells that have been rendered proliferation-incompetent and have been genetically engineered to express GM-CSF, comprising administering an effective amount of a composition comprising cancer cells that have been rendered proliferation-incompetent and have been genetically engineered to express GM-CSF, and detecting an immune response against an antigen listed in Table 1, 2, 3, 4, 5, 6, 7 or 9, wherein detecting the immune response indicates that the subject is responding to said prostate cancer therapy.

In certain embodiments, the subject is a mammal. In certain embodiments, the subject is a human. In certain embodiments, the cancer cells are autologous. In certain embodiments, the cancer cells are allogeneic. In certain embodiments, the cancer cells are LnCaP cells or PC3 cells.

In certain embodiments, an immune response is detected against an antigen listed in Table 1. In certain embodiments, an immune response is detected against an antigen listed in Table 2. In certain embodiments, an immune response is detected against an antigen listed in Table 3. In certain embodiments, an immune response is detected against an antigen listed in Table 4. In certain embodiments, an immune response is detected against an antigen listed in Table 5. In certain embodiments, an immune response is detected against an antigen listed in Table 6. In certain embodiments, an immune response is detected against an antigen listed in Table 7. In certain embodiments, an immune response is detected against an antigen listed in Table 9. In certain embodiments, an immune response is detected against one, two, three, four, five, six, seven, eight, nine, ten, eleven, twelve, thirteen, fourteen, fifteen, or more of the antigens listed in Table 1, 2, 3, 4, 5, 6, 7 or 9.

In certain embodiments, an immune response is detected against HLA-A24, OUTB2, FLJ14668, neuronatin (NNAT) or cardiolipin. In certain embodiments, an immune response is detected against HLA-A24. In certain embodiments, an immune response is detected against OUTB2. In certain embodiments, an immune response is detected against FLJ14668. In certain embodiments, an immune response is detected against NNAT. In certain embodiments, an immune response is detected against cardiolipin. In certain embodiments, an immune response is detected against HLA-A24 and OUTB2. In certain embodiments, an immune response is detected against HLA-A24 or OUTB2. In certain embodiments, an immune response is detected against HLA-A24 and FLJ14668. In certain embodiments, an immune response is detected against HLA-A24 or FLJ14668. In certain embodiments, an immune response is detected against HLA-A24 and NNAT. In certain embodiments, an immune response is detected against HLA-A24 or NNAT. In certain embodiments, an immune response is detected against HLA-A24 and cardiolipin. In certain embodiments, an immune response is detected against HLA-A24 or cardiolipin. In certain embodiments, an immune response is detected against OUTB2 and FLJ14668. In certain embodiments, an immune response is detected against OUTB2 or FLJ14668. In certain embodiments, an immune response is detected against OUTB2 and NNAT. In certain embodiments, an immune response is detected against OUTB2 or NNAT. In certain embodiments, an immune response is detected against OUTB2 and cardiolipin. In certain embodiments, an immune response is detected against OUTB2 or cardiolipin. In certain embodiments, an immune response is detected against FLJ14668 and NNAT. In certain embodiments, an immune response is detected against FLJ14668 or NNAT. In certain embodiments, an immune response is detected against FLJ14668 and cardiolipin. In certain embodiments, an immune response is detected against FLJ14668 or cardiolipin. In certain embodiments, an immune response is detected against NNAT and cardiolipin. In certain embodiments, an immune response is detected against NNAT or cardiolipin. In certain embodiments, an immune response is detected against any three antigens selected from HLA-A24, OUTB2, FLJ14668, NNAT and cardiolipin.

In certain embodiments, responsiveness to the cancer therapy is measured by decreased serum concentrations of tumor specific markers, increased overall survival time, increased progression-free survival, decreased tumor size, decreased bone metastasis marker response, increased impact on minimal residual disease, increased induction of antibody response to the cancer cells that have been rendered proliferation-incompetent, increased induction of delayed-type-hypersensitivity (DTH) response to injections of autologous tumor, increased induction of T cell response to autologous tumor or candidate tumor-associated antigens, or increased impact on circulating T cell and dendritic cell numbers, phenotype, and function, cytokine response.

In certain embodiments, responsiveness to the cancer therapy is measured by decreased serum concentrations of tumor specific markers. In certain embodiments, responsiveness to the cancer therapy is measured by increased overall survival time. In certain embodiments, responsiveness to the cancer therapy is measured by increased progression-free survival. In certain embodiments, responsiveness to the cancer therapy is measured by decreased tumor size. In certain embodiments, responsiveness to the cancer therapy is measured by decreased bone metastasis marker response. In certain embodiments, responsiveness to the cancer therapy is measured by increased impact on minimal residual disease. In certain embodiments, responsiveness to the cancer therapy is measured by increased induction of antibody response to the cancer cells that have been rendered proliferation-incompetent. In certain embodiments, responsiveness to the cancer therapy is measured by increased induction of delayed-type-hypersensitivity (DTH) response to injections of autologous tumor. In certain embodiments, responsiveness to the cancer therapy is measured by increased induction of T cell response to autologous tumor or candidate tumor-associated antigens. In certain embodiments, wherein responsiveness to the cancer therapy is measured by increased impact on circulating T cell and dendritic cell numbers, phenotype, and function, cytokine response.

In certain embodiments, the immune response is a humoral immune response. In certain embodiments, the immune response is a cellular immune response.

In yet another aspect, the invention provides a computer-implemented method for determining whether a subject responding to prostate cancer therapy with a composition comprising cancer cells that have been rendered proliferation-incompetent and have been genetically engineered to express GM-CSF, comprising administering an effective amount of a composition comprising cancer cells that have been rendered proliferation-incompetent and have been genetically engineered to express GM-CSF, inputting into a computer memory data indicating whether an immune response against an antigen listed in Table 1, 2, 3, 4, 5, 6, 7 or 9 is detected, inputting into the computer memory a correlation between an immune response against an antigen listed in Table 1, 2, 3, 4, 5, 6, 7 or 9 and responsiveness to said therapy, and determining whether the subject is responding to said therapy.

In certain embodiments, the subject is a mammal. In certain embodiments, the subject is a human.

In certain embodiments, the cancer cells are autologous. In certain embodiments, the cancer cells are allogeneic. In certain embodiments, the cancer cells are LnCaP cells or PC3 cells.

In certain embodiments, an immune response is detected against an antigen listed in Table 1. In certain embodiments, an immune response is detected against an antigen listed in Table 2. In certain embodiments, an immune response is detected against an antigen listed in Table 3. In certain embodiments, an immune response is detected against an antigen listed in Table 4. In certain embodiments, an immune response is detected against an antigen listed in Table 5. In certain embodiments, an immune response is detected against an antigen listed in Table 6. In certain embodiments, an immune response is detected against an antigen listed in Table 7. In certain embodiments, an immune response is detected against an antigen listed in Table 9. In certain embodiments, an immune response is detected against one, two, three, four, five, six, seven, eight, nine, ten, eleven, twelve, thirteen, fourteen, fifteen, or more of the antigens listed in Table 1, 2, 3, 4, 5, 6, 7 or 9.

In certain embodiments, an immune response is detected against HLA-A24, OUTB2, FLJ14668, neuronatin (NNAT) or cardiolipin. In certain embodiments, an immune response is detected against HLA-A24. In certain embodiments, an immune response is detected against OUTB2. In certain embodiments, an immune response is detected against FLJ14668. In certain embodiments, an immune response is detected against NNAT. In certain embodiments, an immune response is detected against cardiolipin. In certain embodiments, an immune response is detected against HLA-A24 and OUTB2. In certain embodiments, an immune response is detected against HLA-A24 or OUTB2. In certain embodiments, an immune response is detected against HLA-A24 and FLJ14668. In certain embodiments, an immune response is detected against HLA-A24 or FLJ14668. In certain embodiments, an immune response is detected against HLA-A24 and NNAT. In certain embodiments, an immune response is detected against HLA-A24 or NNAT. In certain embodiments, an immune response is detected against HLA-A24 and cardiolipin. In certain embodiments, an immune response is detected against HLA-A24 or cardiolipin. In certain embodiments, an immune response is detected against OUTB2 and FLJ14668. In certain embodiments, an immune response is detected against OUTB2 or FLJ14668. In certain embodiments, an immune response is detected against OUTB2 and NNAT. In certain embodiments, an immune response is detected against OUTB2 or NNAT. In certain embodiments, an immune response is detected against OUTB2 and cardiolipin. In certain embodiments, an immune response is detected against OUTB2 or cardiolipin. In certain embodiments, an immune response is detected against FLJ14668 and NNAT. In certain embodiments, an immune response is detected against FLJ14668 or NNAT. In certain embodiments, an immune response is detected against FLJ14668 and cardiolipin. In certain embodiments, an immune response is detected against FLJ14668 or cardiolipin. In certain embodiments, an immune response is detected against NNAT and cardiolipin. In certain embodiments, an immune response is detected against NNAT or cardiolipin. In certain embodiments, an immune response is detected against any three antigens selected from HLA-A24, OUTB2, FLJ14668, NNAT and cardiolipin.

In certain embodiments, responsiveness to the cancer therapy is measured by decreased serum concentrations of tumor specific markers, increased overall survival time, increased progression-free survival, decreased tumor size, decreased bone metastasis marker response, increased impact on minimal residual disease, increased induction of antibody response to the cancer cells that have been rendered proliferation-incompetent, increased induction of delayed-type-hypersensitivity (DTH) response to injections of autologous tumor, increased induction of T cell response to autologous tumor or candidate tumor-associated antigens, or increased impact on circulating T cell and dendritic cell numbers, phenotype, and function, cytokine response.

In certain embodiments, responsiveness to the cancer therapy is measured by decreased serum concentrations of tumor specific markers. In certain embodiments, responsiveness to the cancer therapy is measured by increased overall survival time. In certain embodiments, responsiveness to the cancer therapy is measured by increased progression-free survival. In certain embodiments, responsiveness to the cancer therapy is measured by decreased tumor size. In certain embodiments, responsiveness to the cancer therapy is measured by decreased bone metastasis marker response. In certain embodiments, responsiveness to the cancer therapy is measured by increased impact on minimal residual disease. In certain embodiments, responsiveness to the cancer therapy is measured by increased induction of antibody response to the cancer cells that have been rendered proliferation-incompetent. In certain embodiments, responsiveness to the cancer therapy is measured by increased induction of delayed-type-hypersensitivity (DTH) response to injections of autologous tumor. In certain embodiments, responsiveness to the cancer therapy is measured by increased induction of T cell response to autologous tumor or candidate tumor-associated antigens. In certain embodiments, responsiveness to the cancer therapy is measured by increased impact on circulating T cell and dendritic cell numbers, phenotype, and function, cytokine response.

In certain embodiments, the immune response is a humoral immune response. In certain embodiments, the immune response is a cellular immune response.

In yet another aspect, the invention provides a method for determining whether a subject is responding to prostate cancer therapy with a composition comprising cancer cells that have been rendered proliferation-incompetent and have been genetically engineered to express GM-CSF, comprising detecting an immune response against an antigen listed in Table 1, 2, 3, 4, 5, 6, 7 or 9 at a first time, administering an effective amount of a composition comprising cancer cells that have been rendered proliferation-incompetent and have been genetically engineered to express GM-CSF, and detecting an immune response against the antigen listed in Table 1, 2, 3, 4, 5, 6, 7 or 9 at a later second time, wherein an increase in the immune response detected at the later second time relative to the earlier first time indicates that the subject is responding to said prostate cancer therapy.

In certain embodiments, the subject is a mammal. In certain embodiments, wherein the subject is a human. In certain embodiments, the cancer cells are autologous. In certain embodiments, the cancer cells are allogeneic. In certain embodiments, the cancer cells are LnCaP cells or PC3 cells.

In certain embodiments, an immune response is detected at the first and second times against an antigen listed in Table 1. In certain embodiments, an immune response is detected at the first and second times against an antigen listed in Table 2. In certain embodiments, an immune response is detected at the first and second times against an antigen listed in Table 3. In certain embodiments, an immune response is detected at the first and second times against an antigen listed in Table 4. In certain embodiments, an immune response is detected at the first and second times against an antigen listed in Table 5. In certain embodiments, an immune response is detected at the first and second times against an antigen listed in Table 6. In certain embodiments, an immune response is detected at the first and second times against an antigen listed in Table 7. In certain embodiments, an immune response is detected at the first and second times against an antigen listed in Table 9. In certain embodiments, an immune response is detected at the first and second times against one, two, three, four, five, six, seven, eight, nine, ten, eleven, twelve, thirteen, fourteen, fifteen, or more of the antigens listed in Table 1, 2, 3, 4, 5, 6, 7 or 9.

In certain embodiments, an immune response is detected against HLA-A24, OUTB2, FLJ14668, neuronatin (NNAT) or cardiolipin. In certain embodiments, an immune response is detected against HLA-A24. In certain embodiments, an immune response is detected against OUTB2. In certain embodiments, an immune response is detected against FLJ14668. In certain embodiments, an immune response is detected against NNAT. In certain embodiments, an immune response is detected against cardiolipin. In certain embodiments, an immune response is detected against HLA-A24 and OUTB2. In certain embodiments, an immune response is detected against HLA-A24 or OUTB2. In certain embodiments, an immune response is detected against HLA-A24 and FLJ14668. In certain embodiments, an immune response is detected against HLA-A24 or FLJ14668. In certain embodiments, an immune response is detected against HLA-A24 and NNAT. In certain embodiments, an immune response is detected against HLA-A24 or NNAT. In certain embodiments, an immune response is detected against HLA-A24 and cardiolipin. In certain embodiments, an immune response is detected against HLA-A24 or cardiolipin. In certain embodiments, an immune response is detected against OUTB2 and FLJ14668. In certain embodiments, an immune response is detected against OUTB2 or FLJ14668. In certain embodiments, an immune response is detected against OUTB2 and NNAT. In certain embodiments, an immune response is detected against OUTB2 or NNAT. In certain embodiments, an immune response is detected against OUTB2 and cardiolipin. In certain embodiments, an immune response is detected against OUTB2 or cardiolipin. In certain embodiments, an immune response is detected against FLJ14668 and NNAT. In certain embodiments, an immune response is detected against FLJ14668 or NNAT. In certain embodiments, an immune response is detected against FLJ14668 and cardiolipin. In certain embodiments, an immune response is detected against FLJ14668 or cardiolipin. In certain embodiments, an immune response is detected against NNAT and cardiolipin. In certain embodiments, an immune response is detected against NNAT or cardiolipin. In certain embodiments, an immune response is detected against any three antigens selected from HLA-A24, OUTB2, FLJ14668, NNAT and cardiolipin.

In certain embodiments, responsiveness to the cancer therapy is measured by decreased serum concentrations of tumor specific markers, increased overall survival time, increased progression-free survival, decreased tumor size, decreased bone metastasis marker response, increased impact on minimal residual disease, increased induction of antibody response to the cancer cells that have been rendered proliferation-incompetent, increased induction of delayed-type-hypersensitivity (DTH) response to injections of autologous tumor, increased induction of T cell response to autologous tumor or candidate tumor-associated antigens, increased impact on circulating T cell and dendritic cell numbers, phenotype, and function, cytokine response, decreased concentrations of PSA, reduced slope of PSA doubling time, increased PSA doubling time, reduced metastasis as measured by bone scan, increased time to progression, increased survival time as compared to the Halabi nomogram, decreased serum concentrations of ICTP, or decreased concentrations of serum C-reactive protein.

In certain embodiments, responsiveness to the cancer therapy is measured by decreased serum concentrations of tumor specific markers. In certain embodiments, responsiveness to the cancer therapy is measured by increased overall survival time. In certain embodiments, responsiveness to the cancer therapy is measured by increased progression-free survival. In certain embodiments, responsiveness to the cancer therapy is measured by decreased tumor size. In certain embodiments, responsiveness to the cancer therapy is measured by decreased bone metastasis marker response. In certain embodiments, responsiveness to the cancer therapy is measured by increased impact on minimal residual disease. In certain embodiments, responsiveness to the cancer therapy is measured by increased induction of antibody response to the cancer cells that have been rendered proliferation-incompetent. In certain embodiments, responsiveness to the cancer therapy is measured by increased induction of delayed-type-hypersensitivity (DTH) response to injections of autologous tumor. In certain embodiments, responsiveness to the cancer therapy is measured by increased induction of T cell response to autologous tumor or candidate tumor-associated antigens. In certain embodiments, responsiveness to the cancer therapy is measured by increased impact on circulating T cell and dendritic cell numbers, phenotype, and function, cytokine response. In certain embodiments, responsiveness to the cancer therapy is measured by decreased concentrations of PSA.

In certain embodiments, responsiveness to the cancer therapy is measured by reduced slope of PSA doubling time. In certain embodiments, responsiveness to the cancer therapy is measured by increased PSA doubling time. In certain embodiments, responsiveness to the cancer therapy is measured by reduced metastasis as measured by bone scan. In certain embodiments, responsiveness to the cancer therapy is measured by increased time to progression. In certain embodiments, responsiveness to the cancer therapy is measured by increased survival time as compared to the Halabi nomogram. In certain embodiments, responsiveness to the cancer therapy is measured by decreased serum concentrations of ICTP. In certain embodiments, responsiveness to the cancer therapy is measured by decreased concentrations of serum C-reactive protein In certain embodiments, the immune response detected at the first and second times is a humoral immune response. In certain embodiments, the immune response detected at the first and second times is a cellular immune response.

In still another aspect, the invention provides a computer-implemented method for determining whether a subject is responding to prostate cancer therapy with a composition comprising cancer cells that have been rendered proliferation-incompetent and have been genetically engineered to express GM-CSF, comprising administering an effective amount of a composition comprising cancer cells that have been rendered proliferation-incompetent and have been genetically engineered to express GM-CSF, inputting into a computer memory data indicating whether an immune response against an antigen listed in Table 1, 2, 3, 4, 5, 6, 7 or 9 is detected at a first time prior to said step of administering and at a later second time subsequent to said step of administering, inputting into the computer memory a correlation between an increase in the immune response against the antigen listed in Table 1, 2, 3, 4, 5, 6, 7 or 9 at said later second time relative to said earlier first time and responsiveness to said therapy, and determining whether the subject is responding to said therapy.

In certain embodiments, the subject is a mammal. In certain embodiments, the subject is a human. In certain embodiments, the cancer cells are autologous. In certain embodiments, the cancer cells are allogeneic. In certain embodiments, the cancer cells are LnCaP cells or PC3 cells.

In certain embodiments, an immune response is detected at said first time and said second time against an antigen listed in Table 1. In certain embodiments, an immune response is detected at said first time and said second time against an antigen listed in Table 2. In certain embodiments, an immune response is detected at said first time and said second time against an antigen listed in Table 3. In certain embodiments, an immune response is detected at said first time and said second time against an antigen listed in Table 4. In certain embodiments, an immune response is detected at said first time and said second time against an antigen listed in Table 5. In certain embodiments, an immune response is detected at said first time and said second time against an antigen listed in Table 6. In certain embodiments, an immune response is detected at said first time and said second time against an antigen listed in Table 7. In certain embodiments, an immune response is detected at said first time and said second time against an antigen listed in Table 9. In certain embodiments, an immune response is detected at said first time and said second time against one, two, three, four, five, six, seven, eight, nine, ten, eleven, twelve, thirteen, fourteen, fifteen, or more of the antigens listed in Table 1, 2, 3, 4, 5, 6, 7 or 9.

In certain embodiments, an immune response is detected against HLA-A24, OUTB2, FLJ14668, neuronatin (NNAT) or cardiolipin. In certain embodiments, an immune response is detected against HLA-A24. In certain embodiments, an immune response is detected against OUTB2. In certain embodiments, an immune response is detected against FLJ14668. In certain embodiments, an immune response is detected against NNAT. In certain embodiments, an immune response is detected against cardiolipin. In certain embodiments, an immune response is detected against HLA-A24 and OUTB2. In certain embodiments, an immune response is detected against HLA-A24 or OUTB2. In certain embodiments, an immune response is detected against HLA-A24 and FLJ14668. In certain embodiments, an immune response is detected against HLA-A24 or FLJ14668. In certain embodiments, an immune response is detected against HLA-A24 and NNAT. In certain embodiments, an immune response is detected against HLA-A24 or NNAT. In certain embodiments, an immune response is detected against HLA-A24 and cardiolipin. In certain embodiments, an immune response is detected against HLA-A24 or cardiolipin. In certain embodiments, an immune response is detected against OUTB2 and FLJ14668. In certain embodiments, an immune response is detected against OUTB2 or FLJ14668. In certain embodiments, an immune response is detected against OUTB2 and NNAT. In certain embodiments, an immune response is detected against OUTB2 or NNAT. In certain embodiments, an immune response is detected against OUTB2 and cardiolipin. In certain embodiments, an immune response is detected against OUTB2 or cardiolipin. In certain embodiments, an immune response is detected against FLJ14668 and NNAT. In certain embodiments, an immune response is detected against FLJ14668 or NNAT. In certain embodiments, an immune response is detected against FLJ14668 and cardiolipin. In certain embodiments, an immune response is detected against FLJ14668 or cardiolipin. In certain embodiments, an immune response is detected against NNAT and cardiolipin. In certain embodiments, an immune response is detected against NNAT or cardiolipin. In certain embodiments, an immune response is detected against any three antigens selected from HLA-A24, OUTB2, FLJ14668, NNAT and cardiolipin.

In certain embodiments, responsiveness to the cancer therapy is measured by decreased serum concentrations of tumor specific markers, increased overall survival time, increased progression-free survival, decreased tumor size, decreased bone metastasis marker response, increased impact on minimal residual disease, increased induction of antibody response to the cancer cells that have been rendered proliferation-incompetent, increased induction of delayed-type-hypersensitivity (DTH) response to injections of autologous tumor, increased induction of T cell response to autologous tumor or candidate tumor-associated antigens, increased impact on circulating T cell and dendritic cell numbers, phenotype, and function, cytokine response, decreased concentrations of PSA, reduced slope of PSA doubling time, increased PSA doubling time, reduced metastasis as measured by bone scan, increased time to progression, increased survival time as compared to the Halabi nomogram, decreased serum concentrations of ICTP, or decreased concentrations of serum C-reactive protein.

In certain embodiments, responsiveness to the cancer therapy is measured by decreased serum concentrations of tumor specific markers. In certain embodiments, responsiveness to the cancer therapy is measured by increased overall survival time. In certain embodiments, responsiveness to the cancer therapy is measured by increased progression-free survival. In certain embodiments, responsiveness to the cancer therapy is measured by decreased tumor size. In certain embodiments, responsiveness to the cancer therapy is measured by decreased bone metastasis marker response. In certain embodiments, responsiveness to the cancer therapy is measured by increased impact on minimal residual disease. In certain embodiments, responsiveness to the cancer therapy is measured by increased induction of antibody response to the cancer cells that have been rendered proliferation-incompetent. In certain embodiments, responsiveness to the cancer therapy is measured by increased induction of delayed-type-hypersensitivity (DTH) response to injections of autologous tumor. In certain embodiments, responsiveness to the cancer therapy is measured by increased induction of T cell response to autologous tumor or candidate tumor-associated antigens. In certain embodiments, responsiveness to the cancer therapy is measured by increased impact on circulating T cell and dendritic cell numbers, phenotype, and function, cytokine response. In certain embodiments, responsiveness to the cancer therapy is measured by decreased concentrations of PSA. In certain embodiments, responsiveness to the cancer therapy is measured by reduced slope of PSA doubling time. In certain embodiments, responsiveness to the cancer therapy is measured by increased PSA doubling time. In certain embodiments, responsiveness to the cancer therapy is measured by reduced metastasis as measured by bone scan. In certain embodiments, responsiveness to the cancer therapy is measured by increased time to progression. In certain embodiments, responsiveness to the cancer therapy is measured by increased survival time as compared to the Halabi nomogram. In certain embodiments, responsiveness to the cancer therapy is measured by decreased serum concentrations of ICTP. In certain embodiments, responsiveness to the cancer therapy is measured by decreased concentrations of serum C-reactive protein.

In certain embodiments, the immune response is a humoral immune response. In certain embodiments, the immune response is a cellular immune response.

In still another aspect, the invention provides computer-readable media embedded with computer executable instructions for performing a method of the invention.

In yet another aspect, the invention provides a computer system configured to perform a method of the invention.

5. BRIEF DESCRIPTION OF THE FIGURES

FIG. 1 presents the expression patterns of PNPO with increasing prostate cancer disease grade derived from the Oncomine database. In FIG. 1, Class 1: Normal prostate (n=41), Class 2: Prostate cancer (n=62), Class 3: Lymph node metastasis (n=9), P-value: 1.25E-5, and Correlation=0.408.

Figure 2:
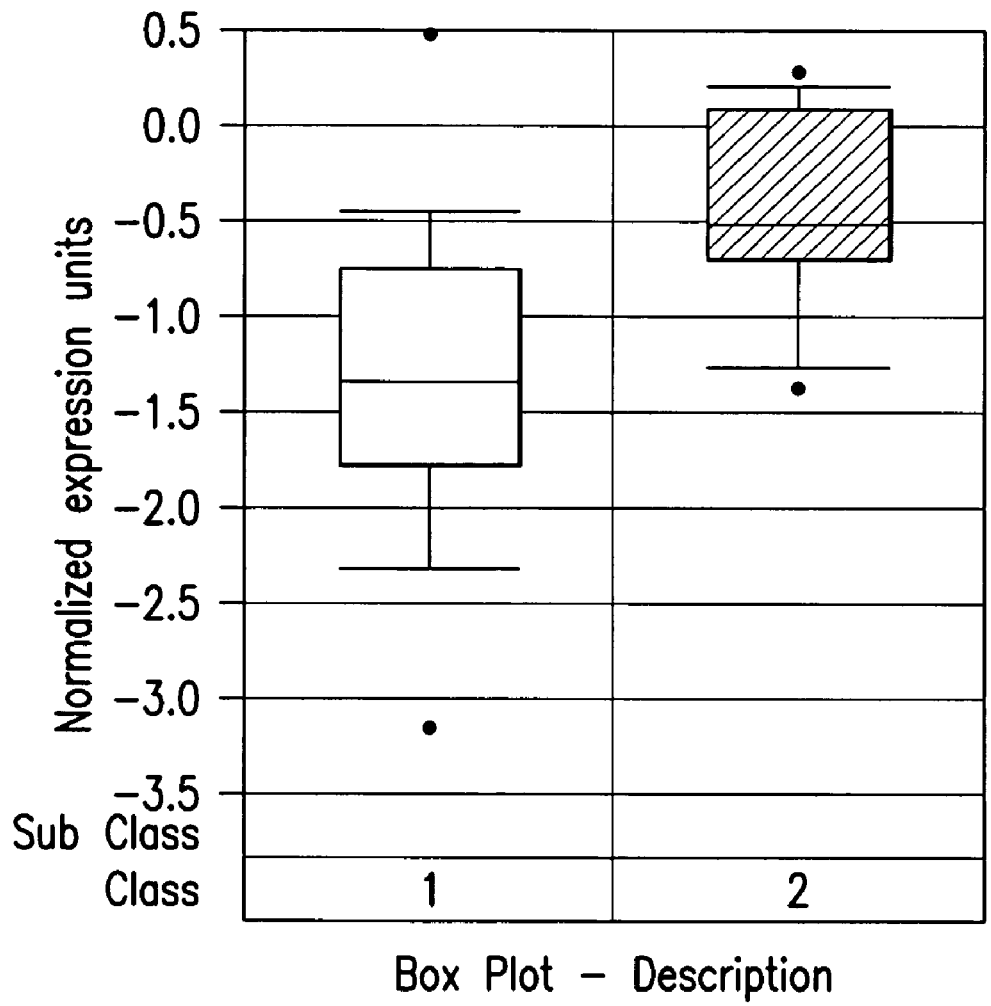

FIG. 2 presents the expression patterns of FLNB with increasing prostate cancer disease grade derived from the Oncomine database. In FIG. 2, Class 1: Prostate carcinoma (n=59), Class 2: Metastatic prostate cancer (n=20), and P-value: 4.6E-7.

Figure 3A:
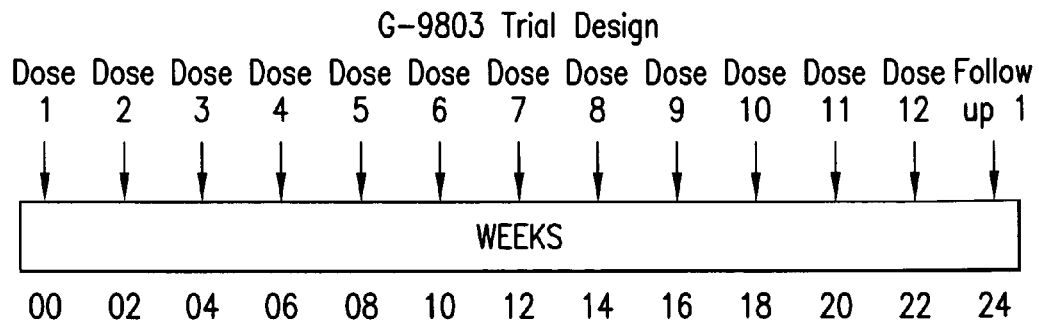

FIG. 3A presents the trial design for the G-9803 Phase II GVAX immunotherapy clinical trial in chemotherapy-naive patients with hormone-refractory prostate cancer (n=55). The trial enrolled PSA-rising patients, who were treated with low-dose GVAX immunotherapy; as well as metastatic patients, who were treated with both low and high-dose GVAX immunotherapy.

Figure 3B:
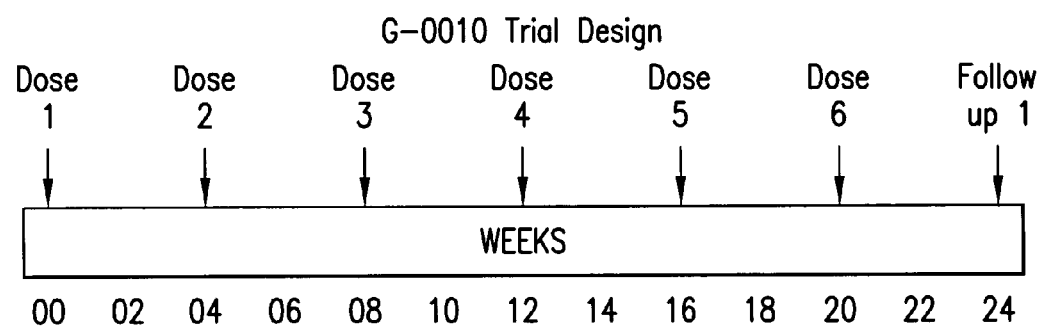
Figure 3B:
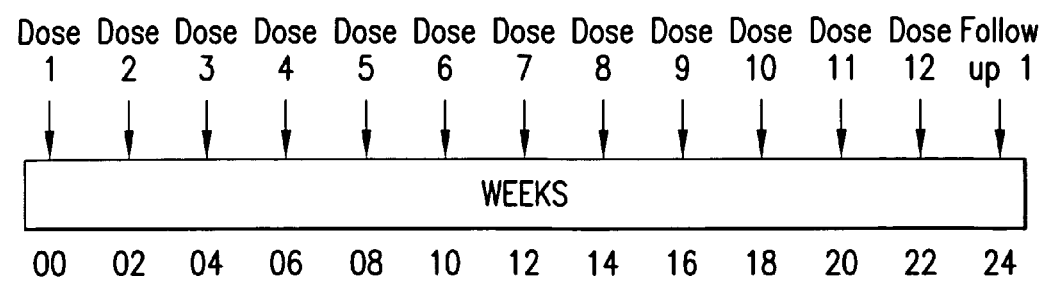

FIG. 3B presents the trial design for the G-0010 Phase II GVAX immunotherapy clinical trial in chemotherapy-naive patients with hormone-refractory prostate cancer (HRPC) (n=80). The trial enrolled metastatic patients, who were treated with low, mid and high-dose GVAX immunotherapy.

Figure 4A:
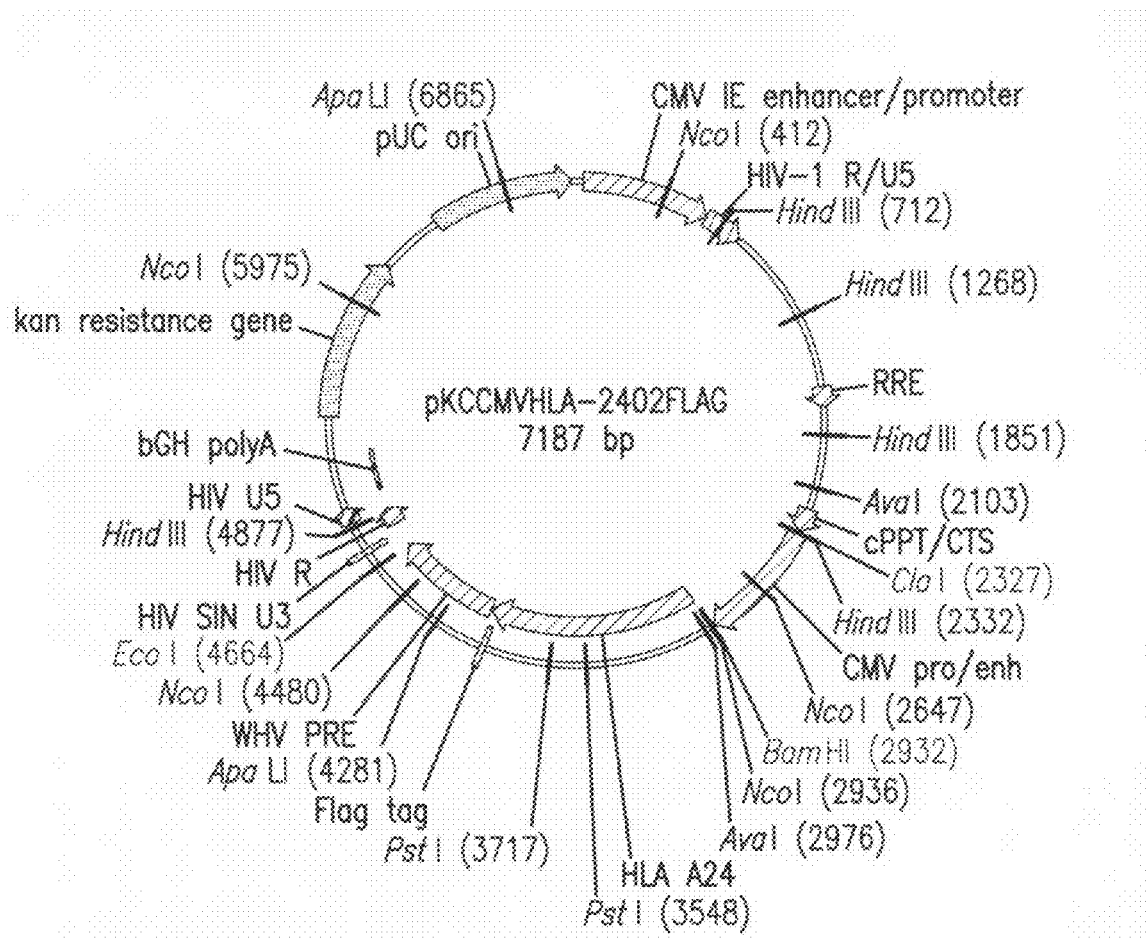

FIG. 4A presents a plasmid map of pKCCMVHLA-A2402Flag.

Figure 4B:
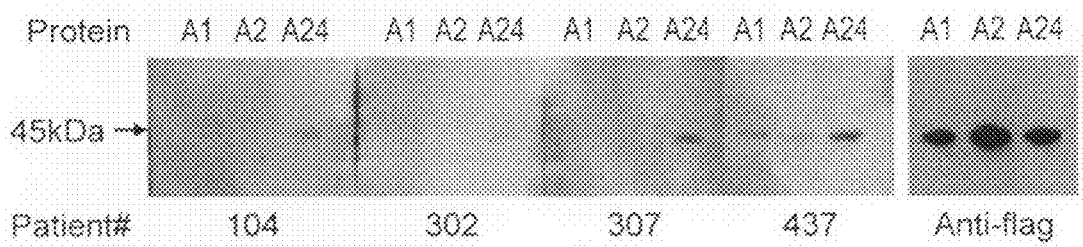

FIG. 4B presents representative blots of HLA-A24 probed with post-vaccination serum from immuno-positive G-0010 patients treated with GVAX immunotherapy for prostate cancer. Serum was diluted 1:500.

Figure 4C:
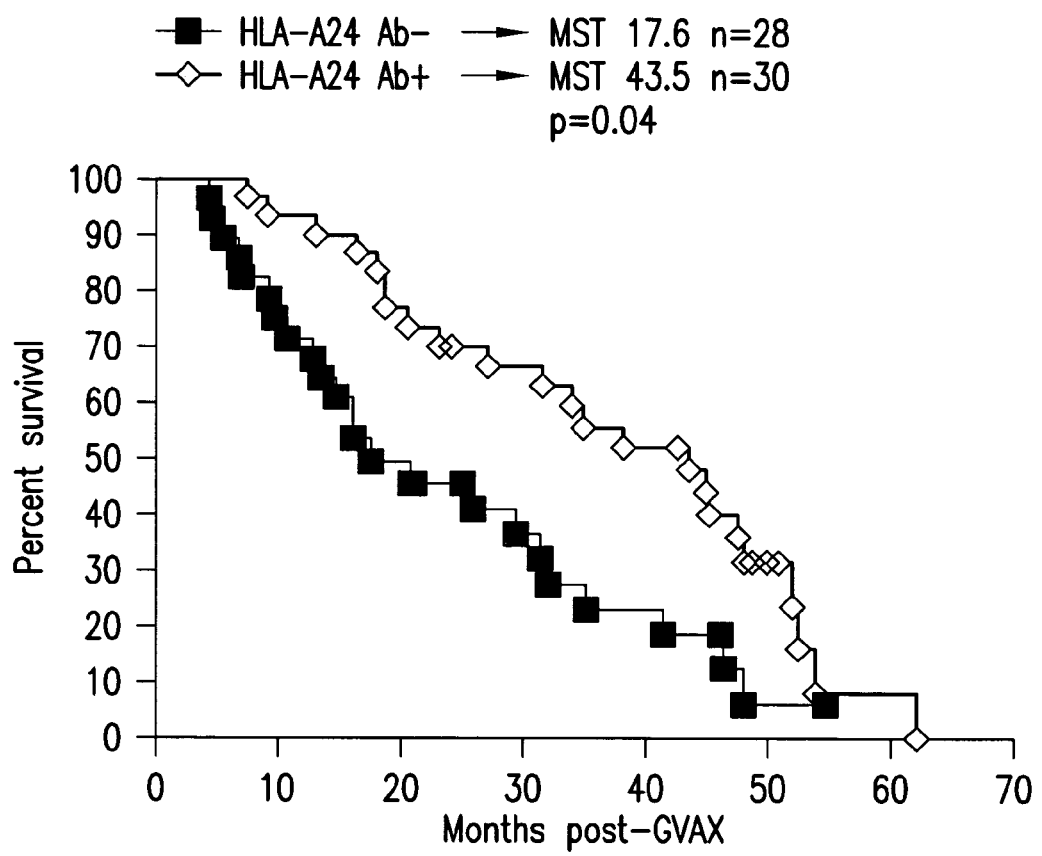

FIG. 4C presents a correlation of HLA-A24 Ab induction with survival in G-0010 patients following GVAX immunotherapy. MST=median survival time.

Figure 5A:
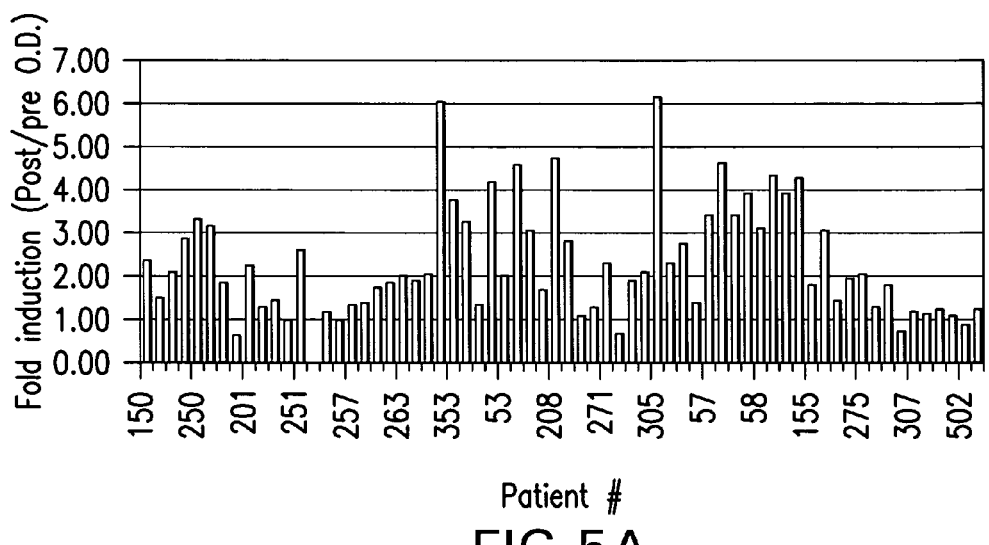

FIG. 5A presents the fold-induction of OUTB2 antibody titer in G-0010 patients following GVAX immunotherapy for prostate cancer.

Figure 5B:
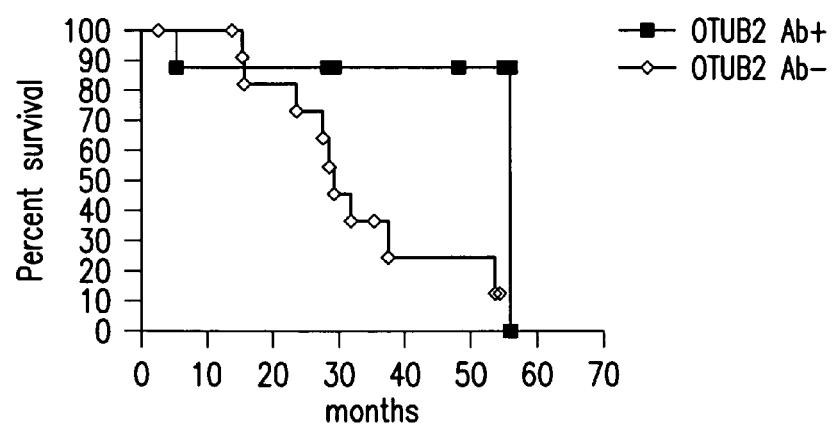

FIG. 5B presents a correlation of OUTB2 Ab induction with survival in G-9803 patients following GVAX immunotherapy. MST=median survival time.

Figure 6A:
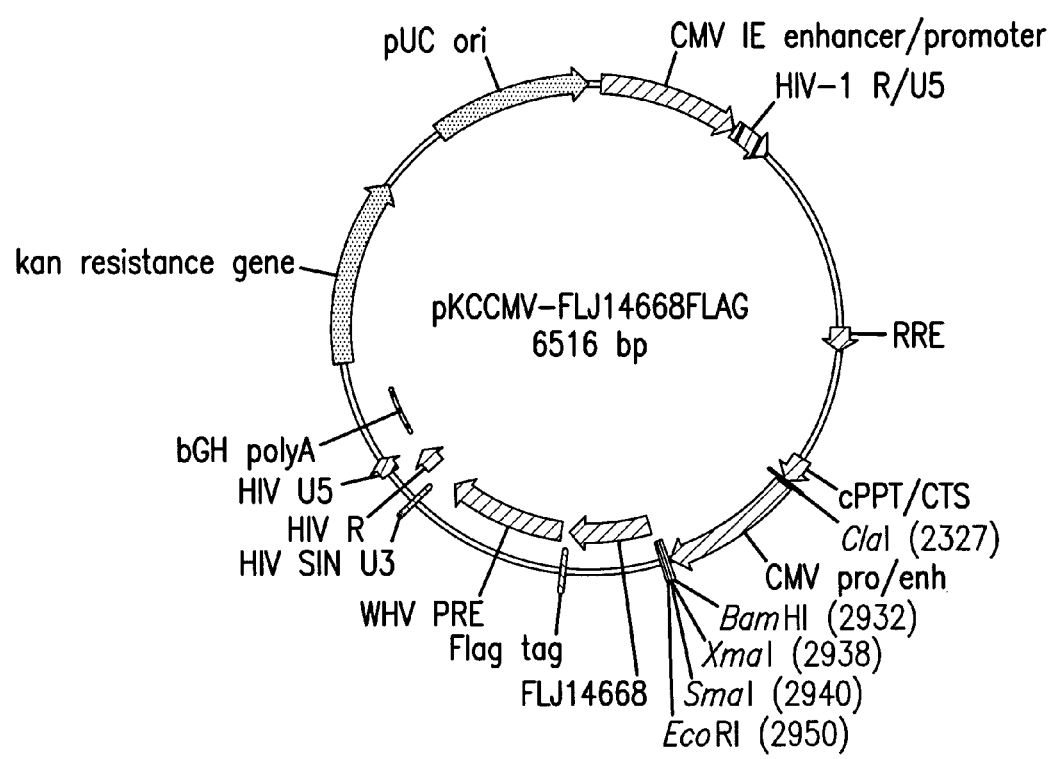

FIG. 6A presents a plasmid map of pKCCMVHLA-A2402Flag.

Figure 6B:
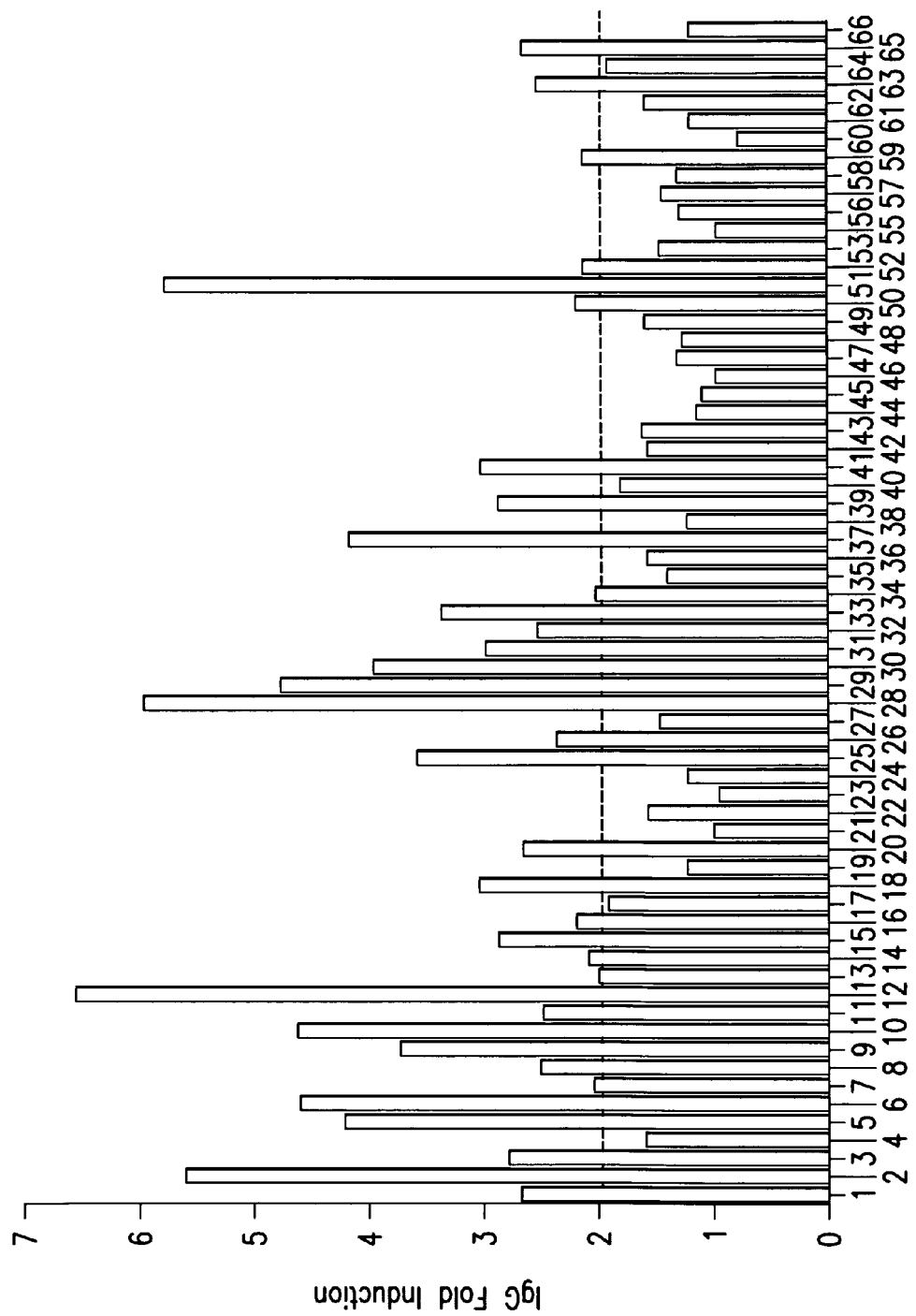

FIG. 6B presents the fold-induction of FLJ14668 antibody titer in G-0010 patients following GVAX immunotherapy for prostate cancer.

Figure 6C:
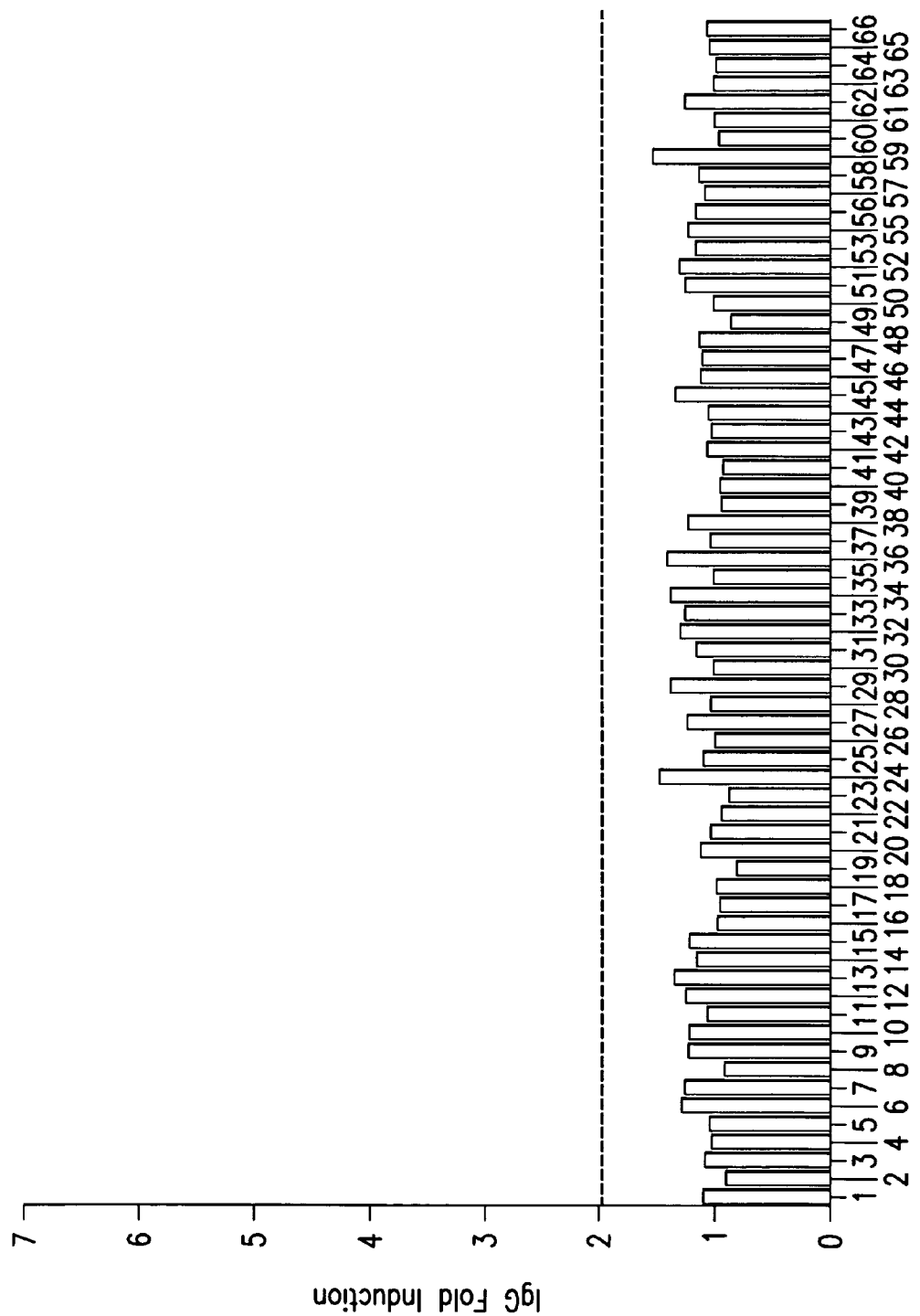

FIG. 6C presents the fold-induction of tetanus toxoid IgG/IgM antibodies in G-0010 patients.

Figure 6D:
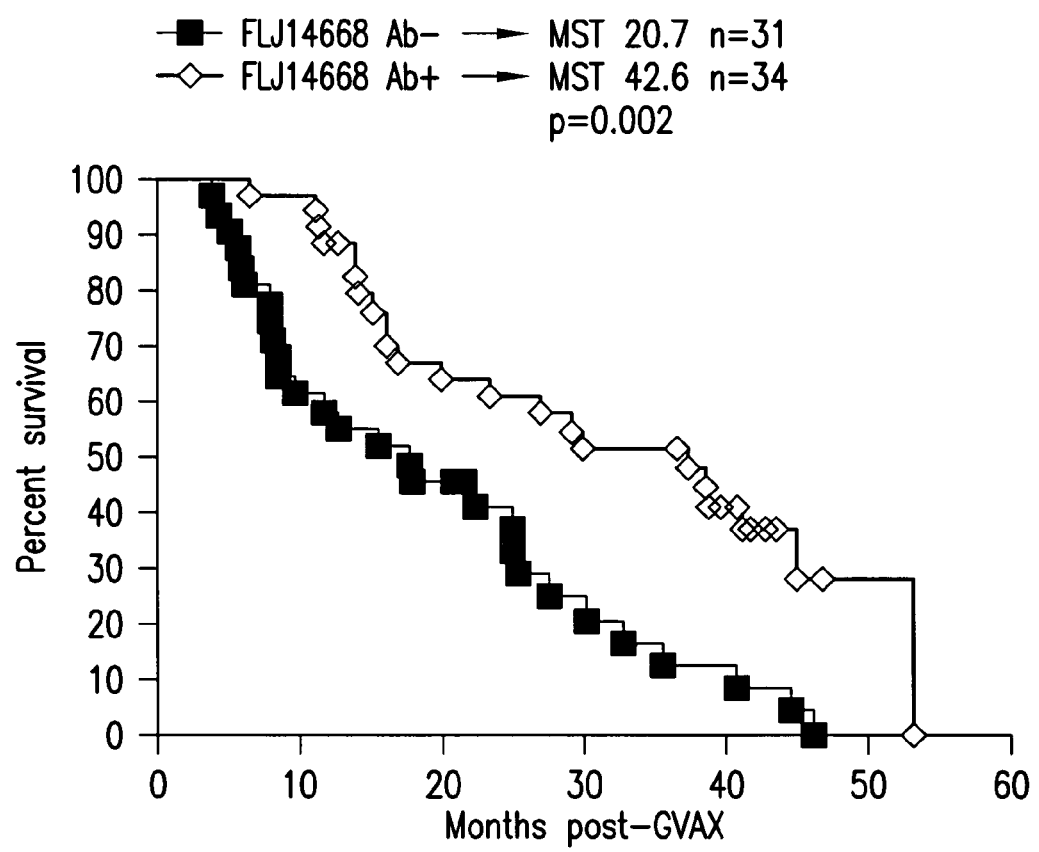

FIG. 6D presents a correlation of FLJ14668 Ab induction with survival in G-0010 patients following GVAX immunotherapy. MST=median survival time.

Figure 6E:
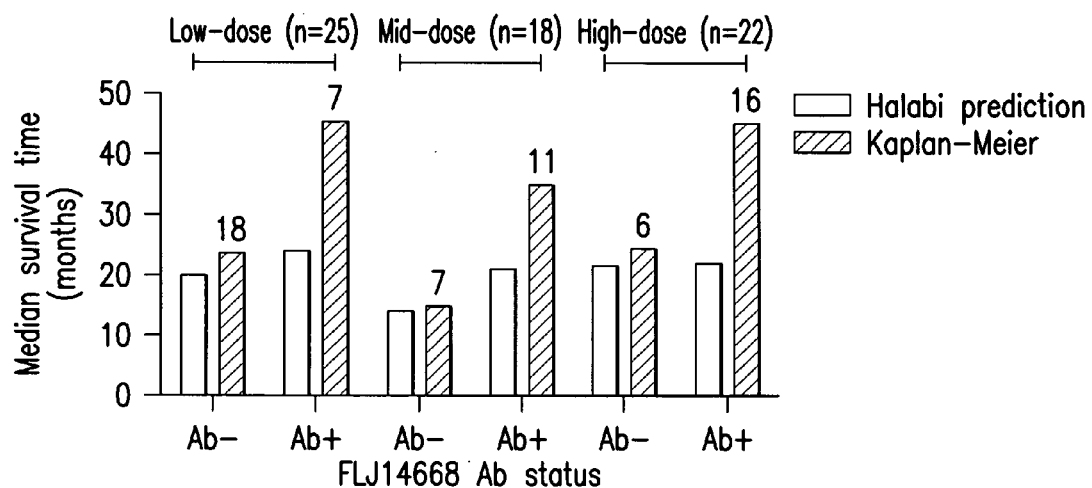

FIG. 6E presents a comparison of predicted and actual survival in FLJ14668 antibody positive and negative patient populations in G-0010.

Figure 6F:
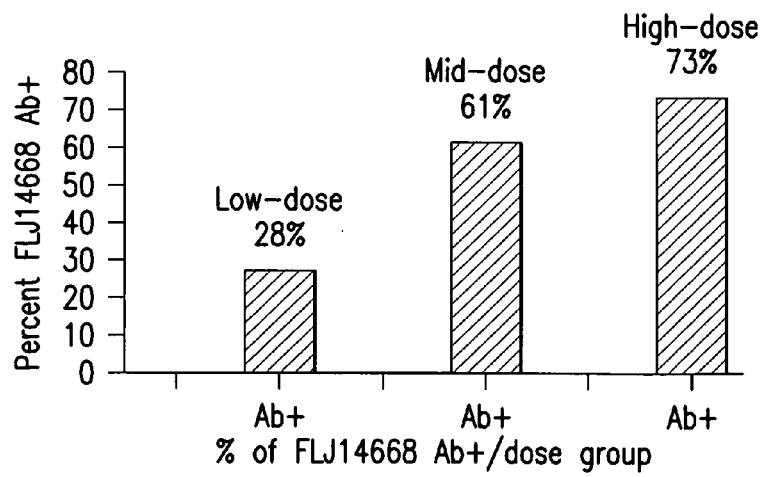

FIG. 6F presents G-0010 FLJ14668 antibody dose-response.

Figure 7A:
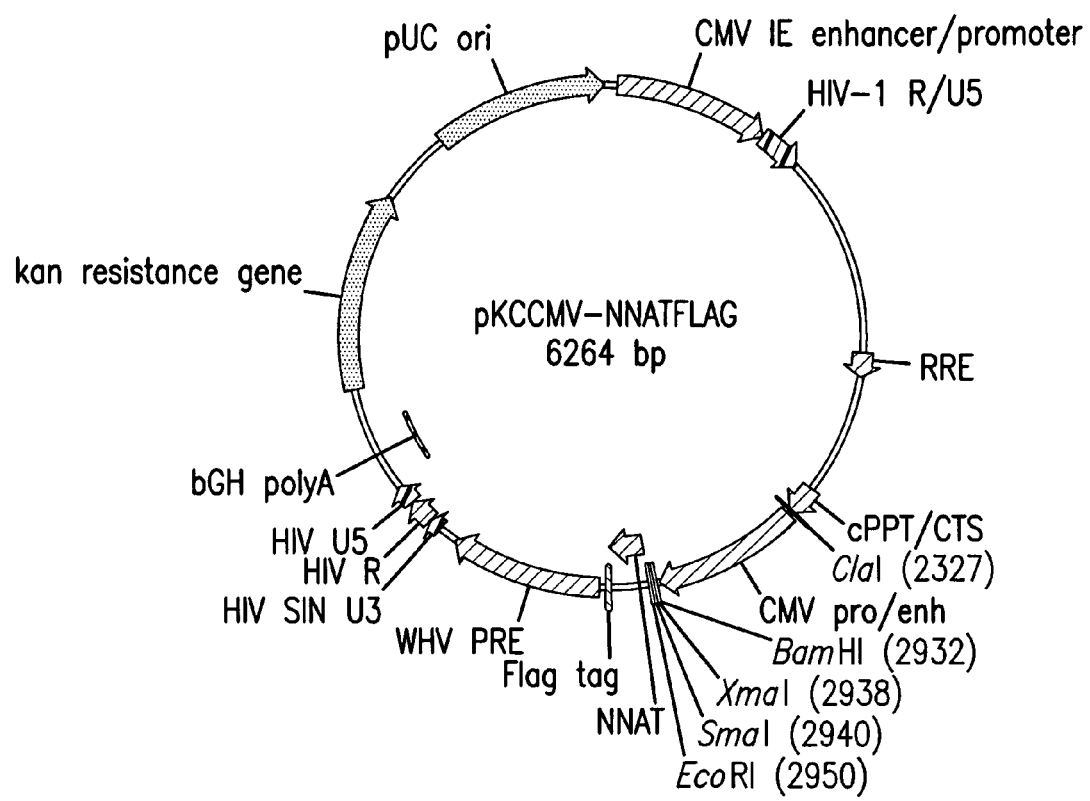

FIG. 7A presents plasmid map of pKCCMV-NNATFlag.

Figure 7B:
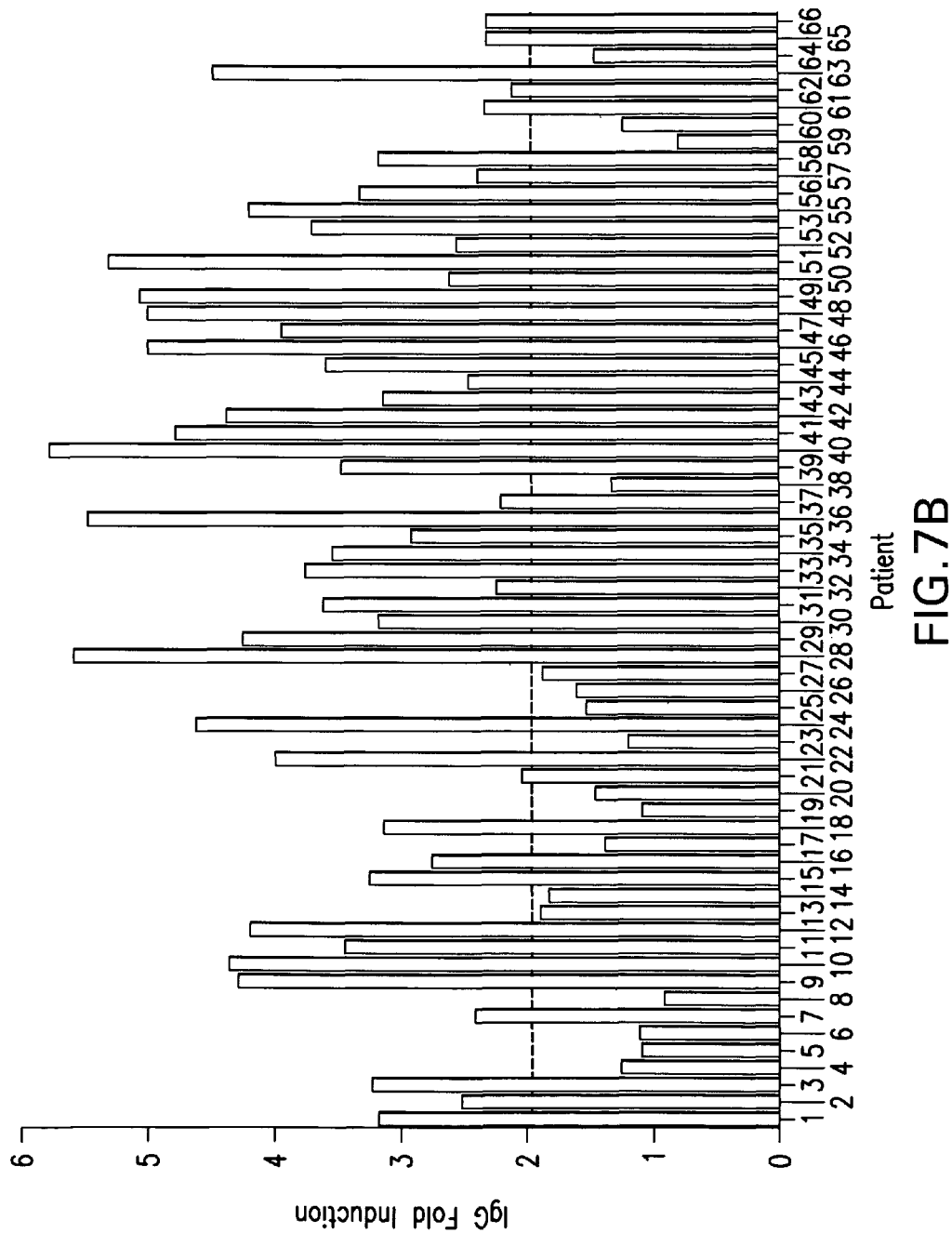

FIG. 7B presents the fold-induction of NNAT IgG/IgM antibodies in G-0010 patients.

Figure 7C:
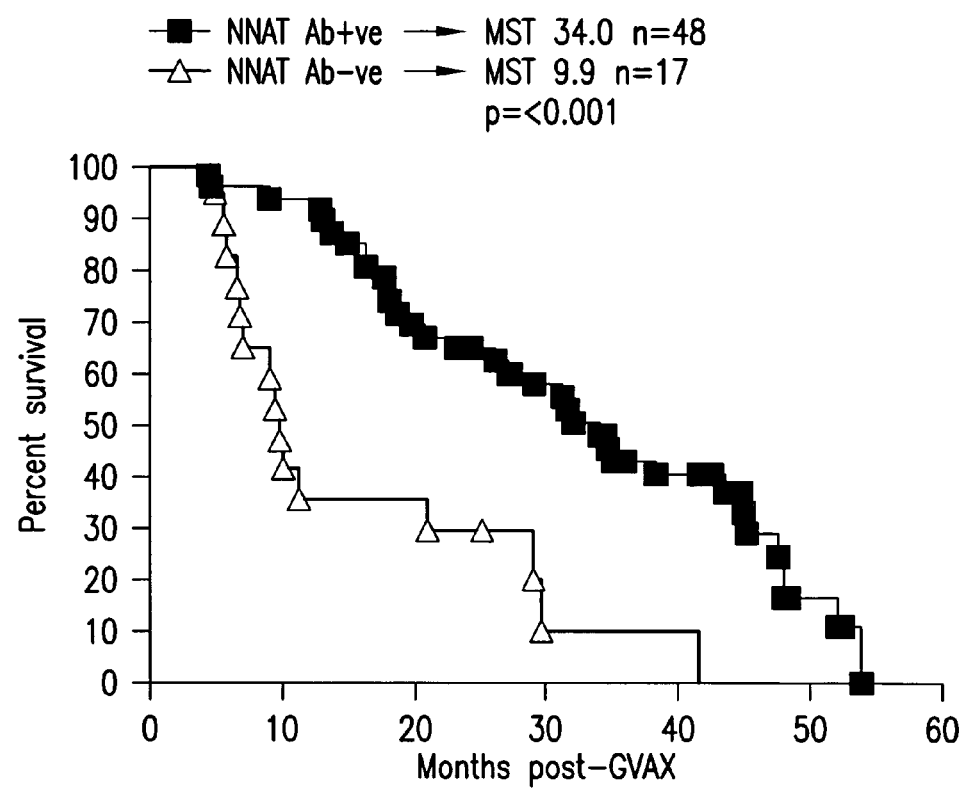

FIG. 7C presents the association of NNAT Ab immune response and survival in G-0010.

Figure 8A:
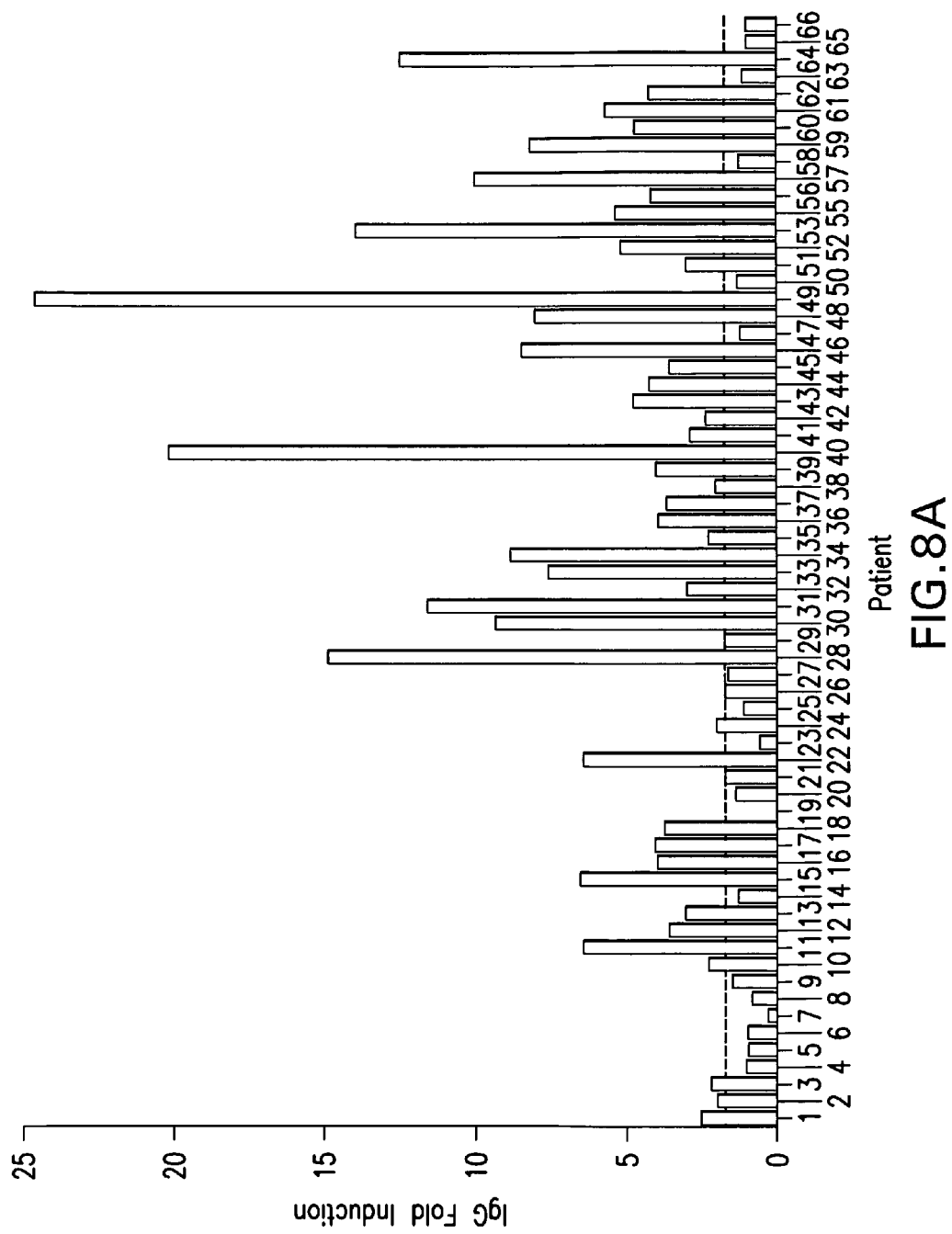

FIG. 8A presents the fold-induction of Cardiolipin IgG/IgM antibodies in G-0010 patients.

Figure 8B:
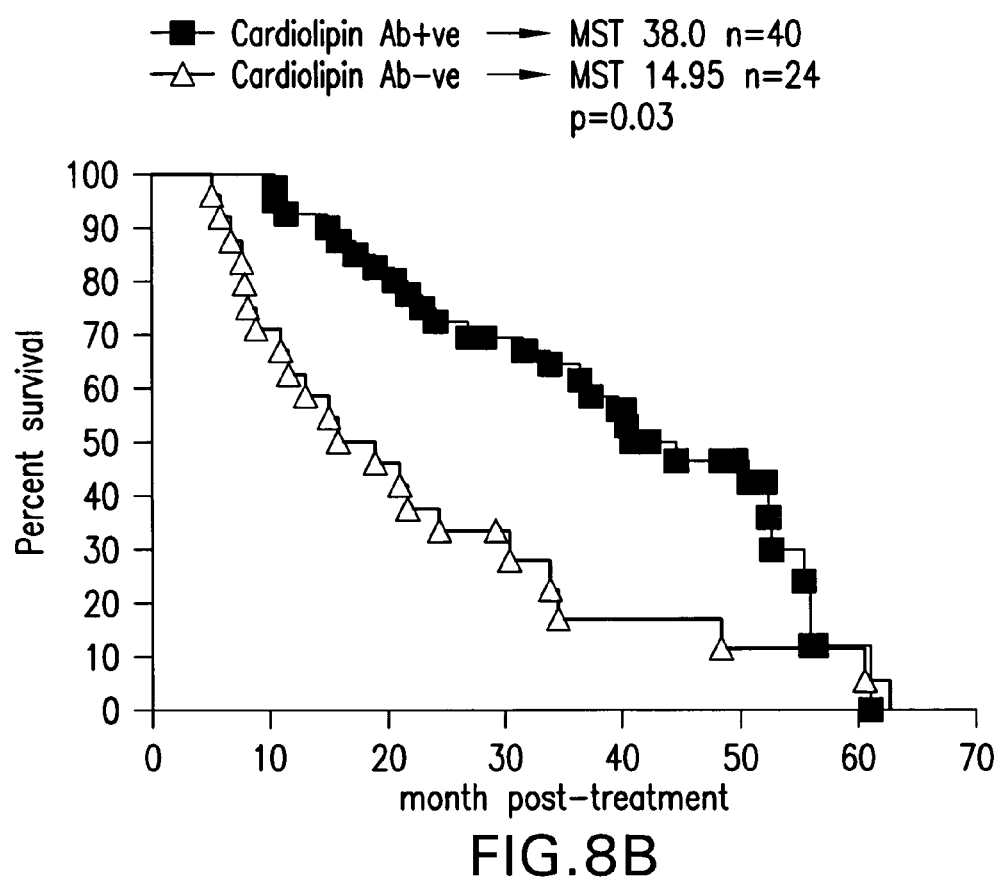

FIG. 8B presents the association of Cardiolipin Ab immune response and survival in G-0010.

Figure 9:
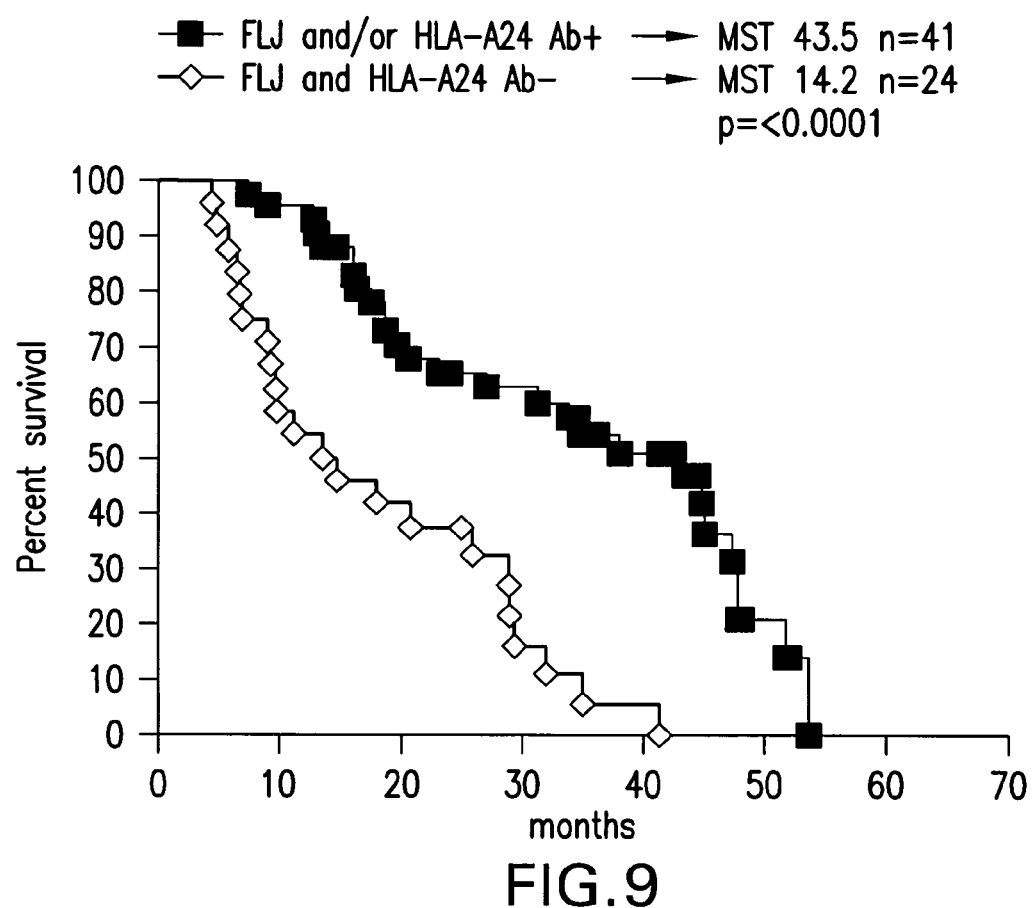

FIG. 9 presents the association of HLA-A24 and/or FLJ14668 immune response and survival in G-0010.

Figure 10:
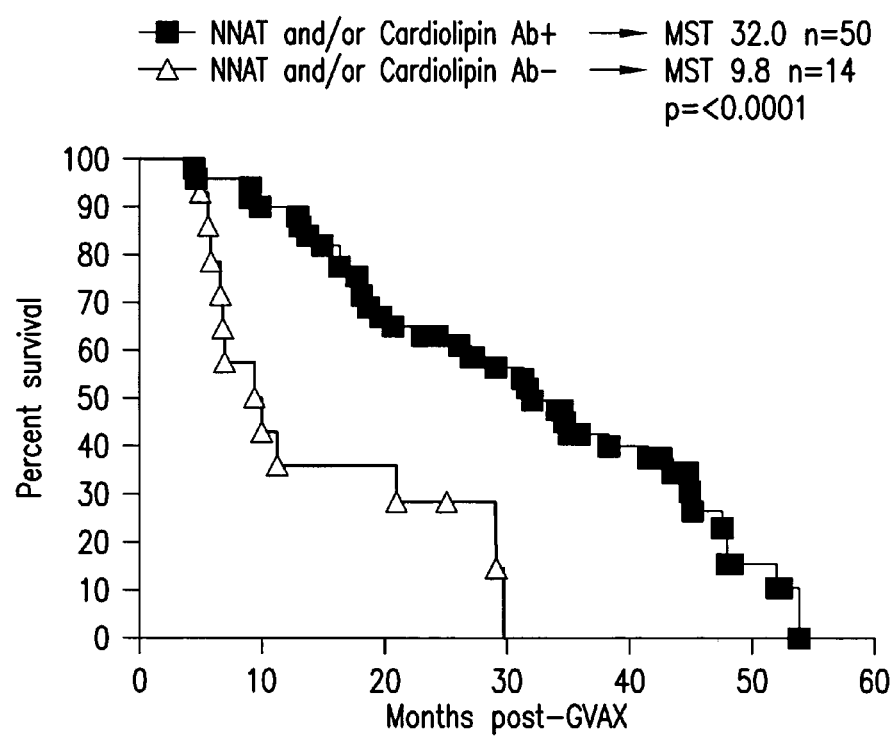

FIG. 10 presents the association of NNAT and/or Cardiolipin immune response and survival in G-0010

Figure 11:
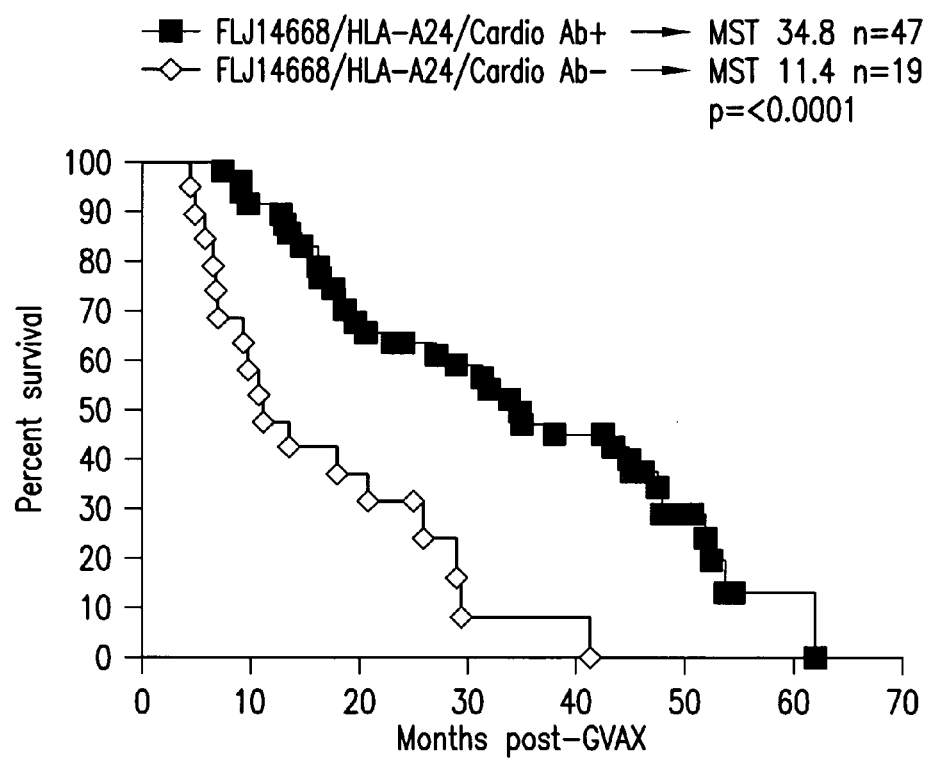

FIG. 11 presents the association of FLJ14668 and/or HLA-A24 and/or Cardiolipin immune response and survival in G-0010.

Figure 12A:
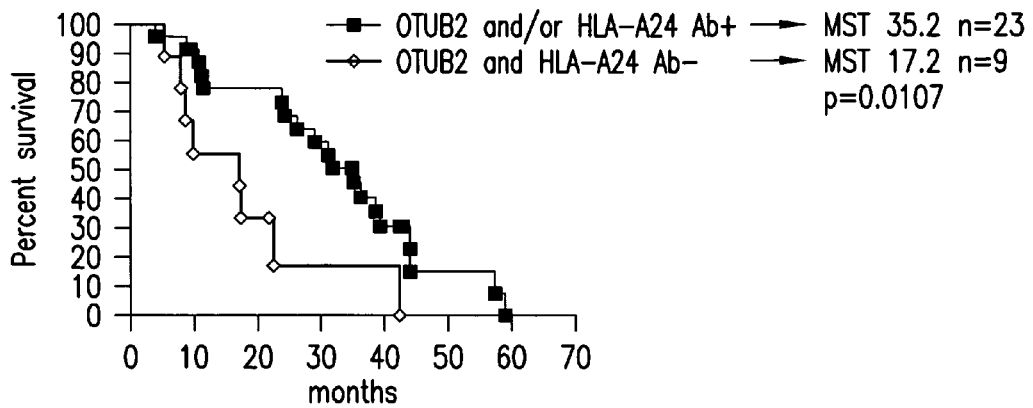

FIG. 12A presents a correlation of HLA-A24 and/or OUTB2 Ab induction with survival in G-9803 metastatic hormone refractory prostate cancer (HRPC) patients following GVAX immunotherapy. MST=median survival time.

Figure 12B:
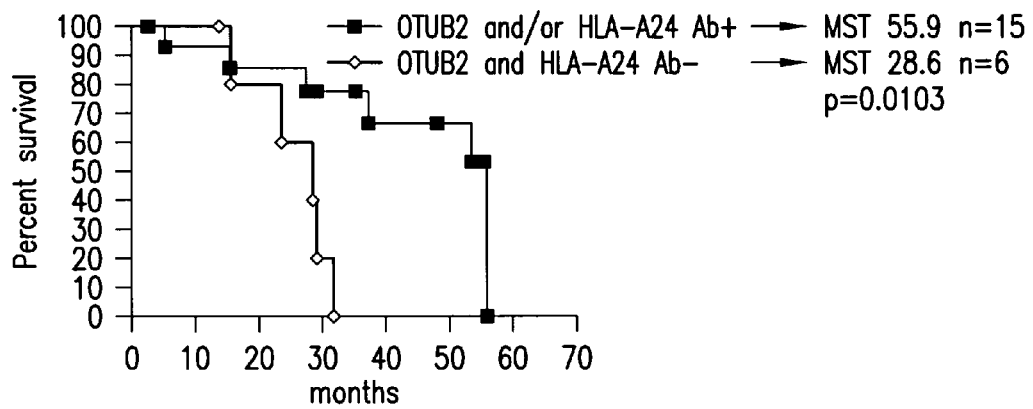

FIG. 12B presents a correlation of HLA-A24 and/or OUTB2 Ab induction with survival in G-9803 PSA-rising HPRC patients following GVAX immunotherapy. MST=median survival time.

Figure 12C:
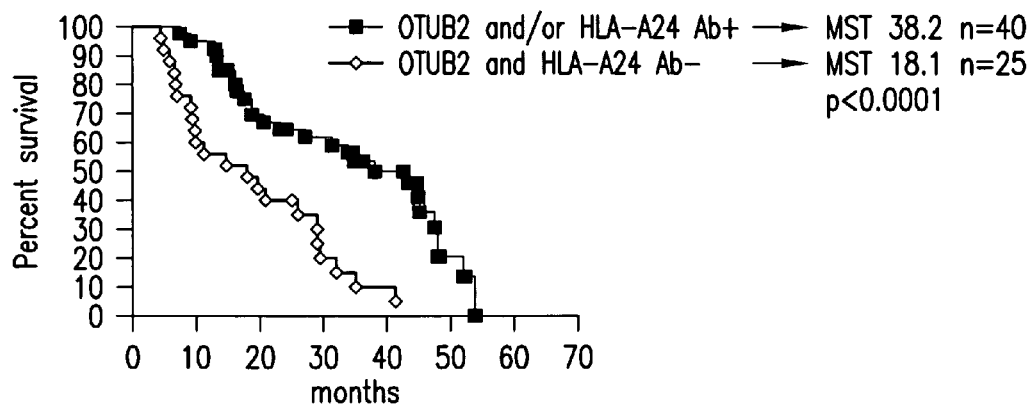

FIG. 12C presents a correlation of HLA-A24 and/or OUTB2 Ab induction with survival in G-0010 metastatic HPRC patients following GVAX immunotherapy. MST=median survival time.

Figure 13A:
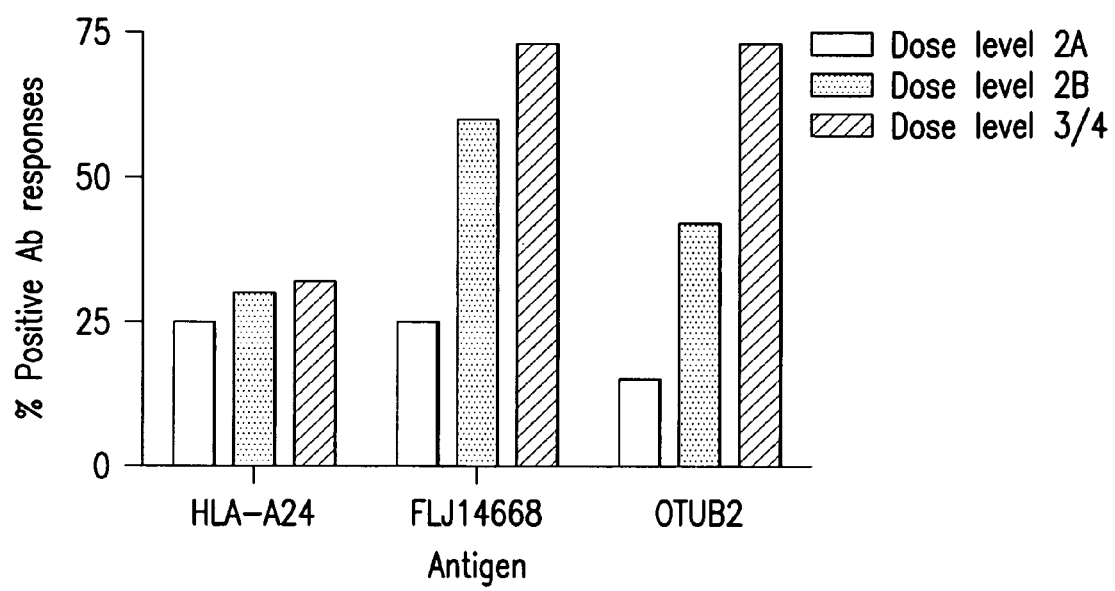

FIG. 13A presents the effect of GVAX immunotherapy dose level on HLA-A24, FLJ14668 and OUTB2 antibody induction in G-0010 patients.

Figure 13B:
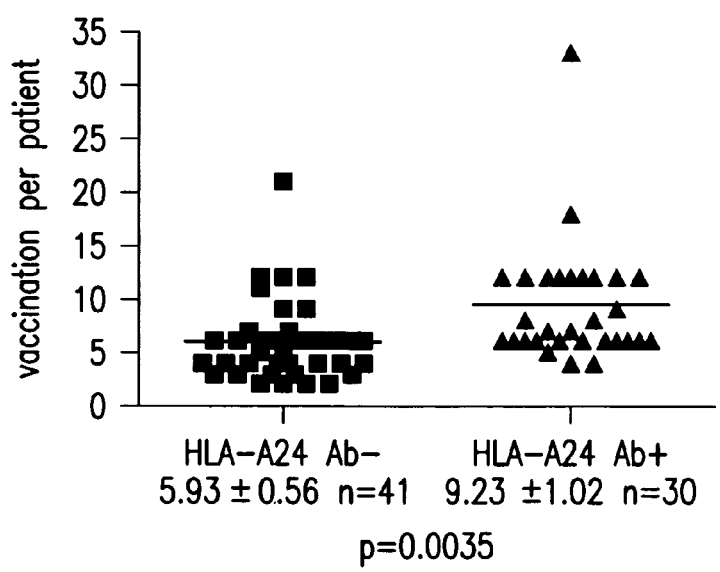

FIG. 13B presents the effect of the number of GVAX vaccinations per patient on HLA-A24 antibody induction in G-0010 patients.

Figure 13C:
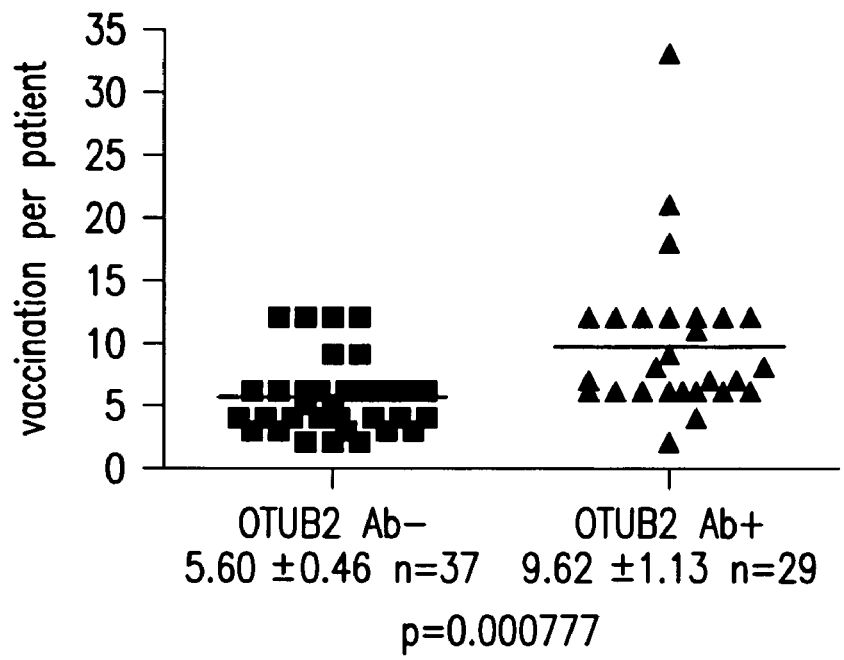

FIG. 13C presents the effect of the number of GVAX vaccinations per patient on OUTB2 antibody induction in G-0010 patients.

Figure 13D:
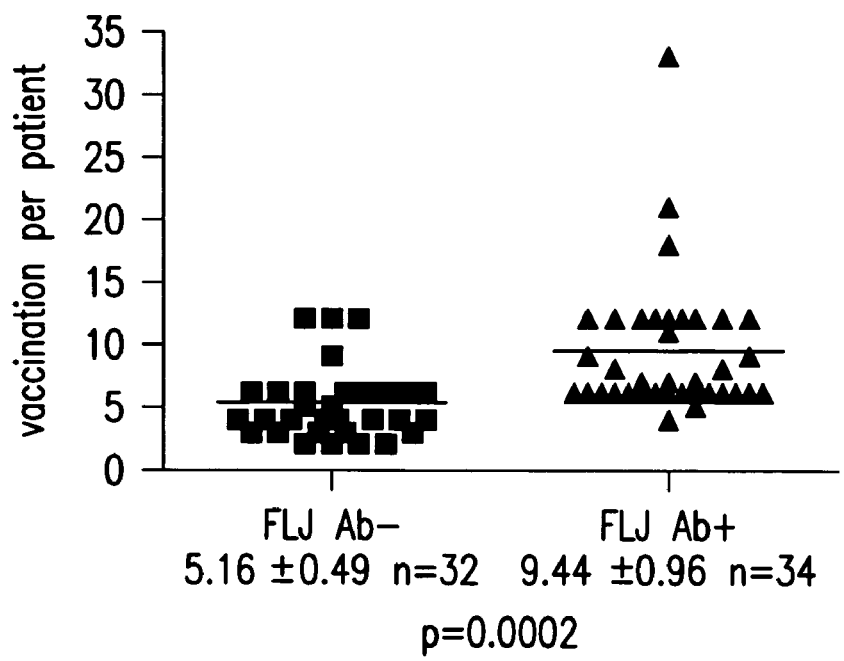

FIG. 13D presents the effect of the number of GVAX vaccinations per patient on FLJ14668 antibody induction in G-0010 patients.

6. DETAILED DESCRIPTION OF THE INVENTION

The present invention provides prostate cancer markers, compositions comprising such markers, immunoglobulins specific for such markers, and methods of using such markers and/or immunoglobulins to assess an immune response against prostate cancer. The markers, compositions, immunoglobulins, and methods are useful, for example, for assessing an immune response, in particular a humoral immune response, against prostate cancer cells which immune response is preferably associated with prophylaxis of prostate cancer, treatment of prostate cancer, and/or amelioration of at least one symptom associated with prostate cancer.

Without intending to be bound to any particular theory or mechanism of action, it is believed that one aspect of the immune response induced by therapy with genetically modified tumor cells that express a cytokine is an immune response against certain polypeptides expressed by the genetically modified tumor cell and/or cells from the tumor afflicting the subject. It is also believed that this immune response plays an important role in the effectiveness of this therapy to treat, e.g., prostate cancer.

6.1 Definitions

By the term "cytokine" or grammatical equivalents, herein is meant the general class of hormones of the cells of the immune system, including lymphokines, monokines, and others. The definition includes, without limitation, those hormones that act locally and do not circulate in the blood, and which, when used in accord with the present invention, will result in an alteration of an individual's immune response. The term "cytokine" or "cytokines" as used herein refers to the general class of biological molecules, which affect cells of the immune system. The definition is meant to include, but is not limited to, those biological molecules that act locally or may circulate in the blood, and which, when used in the compositions or methods of the present invention serve to regulate or modulate an individual's immune response to cancer. Exemplary cytokines for use in practicing the invention include, but are not limited to, interferon-alpha (IFN-alpha), IFN-beta, and IFN-gamma, interleukins (e.g., IL-1 to IL-29, in particular, IL-2, IL-7, IL-12, IL-15 and IL-18), tumor necrosis factors (e.g., TNF-alpha and TNF-beta), erythropoietin (EPO), MIP3a, ICAM, macrophage colony stimulating factor (M-CSF), granulocyte colony stimulating factor (G-CSF) and granulocyte-macrophage colony stimulating factor (GM-CSF).

As used herein, the terms "cancer", "cancer cells", "neoplastic cells", "neoplasia", "tumor", and "tumor cells" (used interchangeably) refer to cells that exhibit relatively autonomous growth, so that they exhibit an aberrant growth phenotype or aberrant cell status characterized by a significant loss of control of cell proliferation. A tumor cell may be a hyperplastic cell, a cell that shows a lack of contact inhibition of growth in vitro or in vivo, a cell that is incapable of metastasis in vivo, or a cell that is capable of metastasis in vivo. Neoplastic cells can be malignant or benign. It follows that cancer cells are considered to have an aberrant cell status. "Tumor cells" may be derived from a primary tumor or derived from a tumor metastases. The "tumor cells" may be recently isolated from a patient (a "primary tumor cell") or may be the product of long term in vitro culture.

The term "primary tumor cell" is used in accordance with the meaning known in the art. A primary tumor cell is a cancer cell that is isolated from a tumor in a mammal and has not been extensively cultured in vitro.

The term "antigen from a tumor cell" and "tumor antigen" and "tumor cell antigen" may be used interchangeably herein and refer to any protein, peptide, carbohydrate or other component derived from or expressed by a tumor cell which is capable of eliciting an immune response. The definition is meant to include, but is not limited to, whole tumor cells, tumor cell fragments, plasma membranes taken from a tumor cell, proteins purified from the cell surface or membrane of a tumor cell, unique carbohydrate moieties associated with the cell surface of a tumor cell or tumor antigens expressed from a vector in a cell. The definition also includes those antigens from the surface of the cell, which require special treatment of the cells to access.

The term "genetically modified tumor cell" as used herein refers to a composition comprising a population of cells that has been genetically modified to express a transgene, and that is administered to a patient as part of a cancer treatment regimen. The genetically modified tumor cell vaccine comprises tumor cells which are "autologous" or "allogeneic" to the patient undergoing treatment or "bystander cells" that are mixed with tumor cells taken from the patient. Generally, the genetically modified tumor cell is of the same general type of tumor cell as is afflicting the patient, e.g., if the patient is afflicted with metastatic prostate cancer, the genetically modified tumor cell is also a metastatic prostate cancer cell. A GM-CSF-expressing genetically modified tumor cell vaccine may be referred to herein as "GVAX"®. Autologous and allogeneic cancer cells that have been genetically modified to express a cytokine, e.g., GM-CSF, followed by readministration to a patient for the treatment of cancer are described in U.S. Pat. Nos. 5,637,483, 5,904,920, 6,277,368 and 6,350,445, each of which is expressly incorporated by reference herein. A form of GM-CSF-expressing genetically modified cancer cells or a "cytokine-expressing cellular vaccine" for the treatment of pancreatic cancer is described in U.S. Pat. Nos. 6,033,674 and 5,985,290, both of which are expressly incorporated by reference herein. A universal immunomodulatory cytokine-expressing bystander cell line is described in U.S. Pat. No. 6,464,973, expressly incorporated by reference herein.

The term "enhanced expression" as used herein, refers to a cell producing higher levels of a particular protein than would be produced by the naturally occurring cell or the parental cell from which it was derived. Cells may be genetically modified to increase the expression of a cytokine, such as GM-CSF. The expression of cytokine may be increased using any method known in the art, such as genetically modifying promoter regions of genomic sequences or genetically altering cellular signaling pathways to increase production of the cytokine. Also, cells can be transduced with a vector coding for the cytokine or immunogenic fragment thereof.

By the term "systemic immune response" or grammatical equivalents herein is meant an immune response which is not localized, but affects the individual as a whole, thus allowing specific subsequent responses to the same stimulus.

As used herein, the term "proliferation-incompetent" or "inactivated" refers to cells that are unable to undergo multiple rounds of mitosis, but still retain the capability to express proteins such as cytokines or tumor antigens. This may be achieved through numerous methods known to those skilled in the art. Embodiments of the invention include, but are not limited to, treatments that inhibit at least about 95%, at least about 99% or substantially 100% of the cells from further proliferation. In one embodiment, the cells are irradiated at a dose of from about 50 to about 200 rads/min or from about 120 to about 140 rads/min prior to administration to the mammal. Typically, when using irradiation, the levels required are 2,500 rads, 5,000 rads, 10,000 rads, 15,000 rads or 20,000 rads. In several embodiments of the invention the cells produce beta-filamin or immunogenic fragment thereof, two days after irradiation, at a rate that is at least about 10%, at least about 20%, at least about 50% or at least about 100% of the pre-irradiated level, when standardized for viable cell number. In one embodiment of the invention, cells are rendered proliferation incompetent by irradiation prior to administration to the subject.

By the term "individual", "subject" or grammatical equivalents thereof is meant any one individual mammal.

By the term "reversal of an established tumor" or grammatical equivalents herein is meant the suppression, regression, or partial or complete disappearance of a pre-existing tumor. The definition is meant to include any diminution in the size, potency or growth rate of a pre-existing tumor.

The terms "treatment", "therapeutic use", or "medicinal use" as used herein, shall refer to any and all uses of the claimed compositions which remedy a disease state or symptom, or otherwise prevent, hinder, retard, or reverse the progression of disease or other undesirable symptoms in any way whatsoever.

The term "administered" refers to any method that introduces the cells of the invention (e.g. cancer vaccine) to a mammal. This includes, but is not limited to, intradermal, parenteral, intramuscular, subcutaneous, intraperitoneal, intranasal, intravenous (including via an indwelling catheter), intratumoral, via an afferent lymph vessel, or by another route that is suitable in view of the patient's condition. The compositions of this invention may be administered to the subject at any site. For example, they can be delivered to a site that is "distal" to or "distant" from the primary tumor.

The term "increased immune response" as used herein means that a detectable increase of a specific immune activation is detectable (e.g. an increase in B-cell and/or T-cell response). An example of an increased immune response is an increase in the amount of an antibody that binds an antigen which is not detected or is detected a lower level prior to administration of a cytokine-expressing cellular vaccine of the invention. Another example, is an increased cellular immune response. A cellular immune response involves T cells, and can be observed in vitro (e.g. measured by a Chromium release assay) or in vivo. An increased immune response is typically accompanied by an increase of a specific population of immune cells.

By the term "retarding the growth of a tumor" is meant the slowing of the growth rate of a tumor, the inhibition of an increase in tumor size or tumor cell number, or the reduction in tumor cell number, tumor size, or numbers of tumors.

The term "inhibiting tumor growth" refers to any measurable decrease in tumor mass, tumor volume, amount of tumor cells or growth rate of the tumor. Measurable decreases in tumor mass can be detected by numerous methods known to those skilled in the art. These include direct measurement of accessible tumors, counting of tumor cells (e.g. present in blood), measurements of tumor antigens (e.g. Prostate Specific Antigen (PSA), Alphafetoprotein (AFP) and various visualization techniques (e.g. MRI, CAT-scan and X-rays). Decreases in the tumor growth rate typically correlates with longer survival time for a mammal with cancer.

By the term "therapeutically effective amount" or grammatical equivalents herein refers to an amount of an agent, e.g., a cytokine-expressing cellular vaccine of the invention, that is sufficient to modulate, either by stimulation or suppression, the immune response of an individual. This amount may be different for different individuals, different tumor types, and different preparations. The "therapeutically effective amount" is determined using procedures routinely employed by those of skill in the art such that an "improved therapeutic outcome" results.

As used herein, the terms "improved therapeutic outcome" and "enhanced therapeutic efficacy", relative to cancer refers to a slowing or diminution of the growth of cancer cells or a solid tumor, or a reduction in the total number of cancer cells or total tumor burden. An "improved therapeutic outcome" or "enhanced therapeutic efficacy" therefore means there is an improvement in the condition of the patient according to any clinically acceptable criteria, including an increase in life expectancy or an improvement in quality of life (as further described herein)

The term "nucleic acid" refers to deoxyribonucleotides or ribonucleotides and polymers thereof ("polynucleotides") in either single- or double-stranded form. Unless specifically limited, the term encompasses nucleic acids containing known analogues of natural nucleotides that have similar binding properties as the reference nucleic acid and are metabolized in a manner similar to naturally occurring nucleotides. Unless otherwise indicated, a particular nucleic acid molecule/polynucleotide also implicitly encompasses conservatively modified variants thereof (e.g. degenerate codon substitutions) and complementary sequences and as well as the sequence explicitly indicated. Specifically, degenerate codon substitutions may be achieved by generating sequences in which the third position of one or more selected (or all) codons is substituted with mixed-base and/or deoxyinosine residues (Batzer et al., Nucleic Acid Res. 19: 5081 (1991); Ohtsuka et al., J. Biol. Chem. 260: 2605-2608 (1985); Rossolini et al., Mol. Cell. Probes 8: 91-98 (1994)). Nucleotides are indicated by their bases by the following standard abbreviations: adenine (A), cytosine (C), thymine (T), and guanine (G).

Stringent hybridization conditions" and "stringent wash conditions" in the context of nucleic acid hybridization experiments such as Southern and Northern hybridizations are sequence dependent, and are different under different environmental parameters. Longer sequences hybridize at higher temperatures. An extensive guide to the hybridization of nucleic acids is found in Tijssen (1993) Laboratory Techniques in Biochemistry and Molecular Biology-Hybridization with Nucleic Acid Probes part 1 chapter 2 "Overview of principles of hybridization and the strategy of nucleic acid probe assays" Elsevier, N.Y. Generally, highly stringent hybridization and wash conditions are selected to be about 5° C. to 20° C. (preferably 5° C.) lower than the thermal melting point ($T_m$) for the specific sequence at a defined ionic strength and pH. Typically, under highly stringent conditions a probe will hybridize to its target subsequence, but to no other unrelated sequences.

The $T_m$ is the temperature (under defined ionic strength and pH) at which 50% of the target sequence hybridizes to a perfectly matched probe. Very stringent conditions are selected to be equal to the $T_m$ for a particular probe. An example of stringent hybridization conditions for hybridization of complementary nucleic acids that have more than 100 complementary residues on a filter in a Southern or northern blot is 50% formamide with 1 mg of heparin at 42° C., with the hybridization being carried out overnight. An example of highly stringent wash conditions is 0.1 5M NaCl at 72° C. for about 15 minutes. An example of stringent wash conditions is a 0.2×SSC wash at 65° C. for 15 minutes (see, Sambrook, infra, for a description of SSC buffer). Often, a high stringency wash is preceded by a low stringency wash to remove background probe signal. An example medium stringency wash for a duplex of, e.g., more than 100 nucleotides, is 1×SSC at 45° C. for 15 minutes. An example low stringency wash for a duplex of, e.g., more than 100 nucleotides, is 4-6×SSC at 40° C. for 15 minutes. For short probes (e.g., about 10 to 50 nucleotides), stringent conditions typically involve salt concentrations of less than about 1.0M Na ion, typically about 0.01 to 1.0 M Na ion concentration (or other salts) at pH 7.0 to 8.3, and the temperature is typically at least about 30° C. Stringent conditions can also be achieved with the addition of destabilizing agents such as formamide. In general, a signal to noise ratio of 2× (or higher) than that observed for an unrelated probe in the particular hybridization assay indicates detection of a specific hybridization The terms "identical" or percent "identity" in the context of two or more nucleic acid or protein sequences, refer to two or more sequences or subsequences that are the same or have a specified percentage of amino acid residues or nucleotides that are the same, when compared and aligned for maximum correspondence, as measured using one of the sequence comparison algorithms described herein or by visual inspection For sequence comparison, typically one sequence acts as a reference sequence to which test sequences are compared. When using a sequence comparison algorithm, test and reference sequences are input into a computer, subsequence coordinates are designated if necessary, and sequence algorithm program parameters are designated. The sequence comparison algorithm then calculates the percent sequence identity for the test sequence(s) relative to the reference sequence, based on the designated program parameters.

Optimal alignment of sequences for comparison can be conducted, e.g., by the local homology algorithm of Smith & Waterman, Adv. Appl. Math. 2:482 (1981), by the homology alignment algorithm of Needleman & Wunsch, J. Mol. Biol. 48: 443 (1970), by the search for similarity method of Pearson & Lipman, Proc. Nat'l. Acad. Sci. USA 85:2444 (1988), by computerized implementations of these algorithms (GAP, BESTFIT, FASTA, and TFASTA in the Wisconsin Genetics Software Package, Genetics Computer Group, 575 Science Dr., Madison, Wis.), by the BLAST algorithm, Altschul et al., J. Mol. Biol. 215: 403-410 (1990), with software that is publicly available through the National Center for Biotechnology Information, or by visual inspection (see generally, Ausubel et al., infra). For purposes of the present invention, optimal alignment of sequences for comparison is most preferably conducted by the local homology algorithm of Smith & Waterman, Adv. Appl. Math. 2: 482 (1981).

As used herein, a "peptide" refers to an amino acid polymer containing between about 8 and about 12 amino acids linked together via peptide bonds. A peptide according to the present invention can comprise additional atoms beyond those of the 8 to twelve amino acids, so long as the peptide retains the ability to bind an MHC I receptor, e.g., an HLA-A2 receptor, and form a ternary complex with the T-cell receptor, the MHC I receptor, and the peptide.

Conservative substitution" refers to the substitution in a polypeptide of an amino acid with a functionally similar amino acid. The following six groups each contain amino acids that are conservative substitutions for one another:

Alanine (A), Serine (S), and Threonine (T)
Aspartic acid (D) and Glutamic acid (E)
Asparagine (N) and Glutamine (Q)
Arginine (R) and Lysine (K)
Isoleucine (I), Leucine (L), Methionine (M), and Valine (V)
Phenylalanine (F), Tyrosine (Y), and Tryptophan (W).

The term "about," as used herein, unless otherwise indicated, refers to a value that is no more than 10% above or below the value being modified by the term. For example, the term "about 5 µg/kg" means a range of from 4.5 µg/kg to 5.5 µg/kg. As another example, "about 1 hour" means a range of from 48 minutes to 72 minutes. Where the term "about" modifies a value that must be an integer, and 10% above or below the value is not also an integer, the modified value should be rounded to the nearest whole number. For example, "about 12 amino acids" means a range of 11 to 13 amino acids.

The term "physiological conditions," as used herein, refers to the salt concentrations normally observed in human serum. One skilled in the art will recognize that physiological conditions need not mirror the exact proportions of all ions found in human serum, rather, considerable adjustment can be made in the exact concentration of sodium, potassium, calcium, chloride, and other ions, while the overall ionic strength of the solution remains constant.

6.2 Antigens Associated with Therapy with Proliferation Incompetent Tumor Cells that Express GM-CSF In certain aspects as described below, the invention provides methods that comprise assessing immune responses against antigens associated with a likelihood of responsiveness to treatment with proliferation-incompetent tumor cells that express cytokines, e.g., GM-CSF. In some embodiments, the therapies are predicted to results in an improved therapeutic outcome for the subject, for example, a reduction in the level of PSA in the patient's serum, a decrease in cancer-associated pain or improvement in the condition of the patient according to any clinically acceptable criteria, including but not limited to a decrease in metastases, an increase in life expectancy or an improvement in quality of life. The antigens may be expressed endogenously by cells native to the subject or may be exogenously provided to the subject by, e.g., the administered engineered tumor cells. The discussion below briefly describes examples of such antigens.

HLA class I histocompatibility antigen, A-24 alpha chain precursor (alias MHC class I antigen A*24, Aw-24, A-9) is a 40689 Da protein of 365 amino acids (SEQ ID NO:1) encoded on chromosome 6 (Entrez Gene cytogenetic band 6p21.3). Representative nucleotide sequence HLA-A2402 is shown (SEQ ID NO: 2). HLA-A24 belongs to the HLA class I heavy chain paralogues (N'guyen et al. 1985; Little et al. 1992). This class 1 molecule is a heterodimer consisting of a heavy chain and a light chain (β-2 microglobulin). The heavy chain is anchored in the membrane as a single-pass type I membrane protein. HLA-A24 plays a central role in the immune system by presenting peptides derived from the endoplasmic reticulum lumen. The following alleles of A-24 are known: A*2401, A*2402, A*2403, A*2406, A*2408 (A9HH), A*2410 (A*24JV), A*2413 (A*24YM) and A*2414 (A*24SA). Allele A*2402 is represented in all major racial groups. Allele A*2406 and allele A*2413 are found in the Australian Aboriginal population. Allele A*2414 is found in individuals of South American descent. See N'Guyen C, Sodoyer R, Trucy J, Strachan T, Jordan B R. The HLA-AW24 gene: sequence, surroundings and comparison with the HLA-A2 and HLA-A3 genes. Immunogenetics. 1985; 21(5):479-

89. PMID: 2987115 and Little A M, Madrigal J A, Parham P. Molecular definition of an elusive third HLA-A9 molecule: HLA-A9.3. Immunogenetics. 1992; 35(1):41-5. PMID: 1729171

FLNB (alias filamin β, actin binding protein 278, AOI, FH1, SCT, TAP, LRS1, TABP, FLN1L, ABP-278, DKFZp6860033, DKFZp686A1668) encodes a 278195 Da protein of 2602 amino acids (SEQ ID NO: 3) Filamin B encoded at chromosome 3 (3p14.3). Representative nucleotide sequence NM_001457 (SEQ ID NO: 4). Functions to connect cell membrane constituents to the actin cytoskeleton and may promote orthogonal branching of actin filaments and linking filaments to membrane glycoproteins (Popowicz et al. 2006; Feng and Walsh 2004; Robertson 2004). Anchors various transmembrane proteins to the actin cytoskeleton. Interaction with FLNA may allow neuroblast migration from the ventricular zone into the cortical plate. Various interactions and localizations of isoforms affect myotube morphology and myogenesis. Interacts with FBLP1, FLNA, FLNC, GP1BA, INPPL1, ITGB1A, PSEN1, FOLH1, PSEN2, MYOT and MYOZ1. Cytoplasmic, membrane associated localization. See Popowicz G M, Schleicher M, Noegel A A, Holak T A. Filamins: promiscuous organizers of the cytoskeleton. Trends Biochem Sci. 2006 July; 31(7):411-9. Epub 2006 Jun. 16. PMID: 16781869 and Feng Y, Walsh C A. The many faces of filamin: a versatile molecular scaffold for cell motility and signaling. Nat Cell Biol. November; 6(11):1034-8. PMID: 15516996 and Robertson S P. Molecular pathology of filamin A: diverse phenotypes, many functions. Clin Dysmorphol. 2004 July; 13(3):123-31. PMID: 15194946.

NSFL1 (alias MGC3347; UBXD10; p97 cofactor p47) encodes a 40573 Da protein of 370 amino acids, NSFL1 (p97) cofactor (p47) (SEQ ID NO: 5) Gene is encoded at chromosome 20 (20p13). Representative nucleotide sequence NM_016143 (SEQ ID NO:6). N-ethylmaleimide-sensitive factor (NSF) and valosin-containing protein (VCP; p97) are two ATPases known to be involved in transport vesicle/target membrane fusion and fusions between membrane compartments. A trimer of the protein encoded by NSFL1C binds a hexamer of cytosolic p97 and is required for p97-mediated re-growth of Golgi cisternae from mitotic Golgi fragments (Bruderer et al. 2004; Meyer et al. 1998; Kondo et al. 1997). Reduces the ATPase activity of VCP (Ye et al. 2001). May play a role in VCP-mediated formation of transitional endoplasmic reticulum (tER). Predominantly nuclear subcellular localization nuclear in interphase cells. Bound to the axial elements of sex chromosomes in pachytene spermatocytes. See Bruderer R M, Brasseur C, Meyer H H. The AAA ATPase p97/VCP interacts with its alternative co-factors, Ufd1-Npl4 and p47, through a common bipartite binding mechanism. J Biol Chem. 2004 Nov. 26; 279(48):49609-16. Epub 2004 Sep. 15. PMID: 15371428 and Ye Y, Meyer H 8H, Rapoport T A. The AAA ATPase Cdc48/p97 and its partners transport proteins from the ER into the cytosol. Nature. 2001 Dec. 6; 414(6864):652-6. PMID: 11740563 and Meyer H H, Kondo H, Warren G. The p47 co-factor regulates the ATPase activity of the membrane fusion protein, p97. FEBS Lett. 1998 Oct. 23; 437(3):255-7. PMID: 9824302 and Kondo H, Rabouille C, Newman R, Levine T P, Pappin D, Freemont P, Warren G. p47 is a cofactor for p97-mediated membrane fusion. Nature. 1997 Jul. 3; 388(6637):75-8. PMID: 9214505.

PNPO (alias FLJ10535; PDXPO; PNPO) encodes a 29988 Da protein of 261 amino acids, Pyridoxamine 5'-phosphate oxidase (SEQ ID NO: 7). Gene is encoded at chromosome 17 (17q21.32). Representative nucleotide sequence from NM_018129 (SEQ ID NO: 8). Vitamin B6, or pyridoxal 5-prime-phosphate (PLP), is critical for normal cellular function including synthesis of neurotransmitters, enzymatic co-factor and modulator of steroid-receptor interactions. The rate-limiting enzyme in vitamin B6 synthesis is PNPO which oxidizes PNP and PMP into pyridoxal 5'-phosphate (PLP) (Kang et al. 2004). Functions as a homodimer in a cytoplasmic localization. Absence of PNPO activity has been noted in neoplastic/cancerous cells (Ngo et al. 1998) See Kang J H, Hong M L, Kim D W, Park J, Kang T C, Won M H, Baek N I, Moon B J, Choi S Y, Kwon O S. Genomic organization, tissue distribution and deletion mutation of human pyridoxine 5'-phosphate oxidase. Eur J Biochem. 2004 June; 271(12): 2452-61. PMID: 15182361 and Ngo E O, LePage G R, Thanassi J W, Meisler N, Nutter L M. Absence of pyridoxine-5'-phosphate oxidase (PNPO) activity in neoplastic cells: isolation, characterization, and expression of PNPO cDNA. Biochemistry. 1998 May 26; 37(21):7741-8. PMID: 9601034.

SVH (alias MGC3195, PNAS-112) encodes a 37540 Da protein of 343 amino acids, Specific Splicing Variant involved in Hepatocarcinogenesis (SEQ ID NO:9). Gene is encoded on chromosome 7 (7q22.1). Representative nucleotide sequence from NM_031905 (SEQ ID NO: 10). A novel gene SVH, up-regulated in hepatocellular carcinoma, was identified by Huang et al. (2003) and found to encode four armadillo repeat containing variants SVH-A, -B, -C, and -D, resulting from alternative splicing in the coding region of the SVH transcript. The protein splice variants appear to localize in the endoplasmic reticulum. Gene has significant similarities to the ALEX1, ALEX2, and ALEX3 genes. Notably, it was reported that expression of ALEX1 and ALEX2 is lost or significantly reduced in human lung, prostate, colon, pancreas, and ovarian carcinomas and also in the cell lines established from different human carcinomas (Kurochkin et al. 2001), however the function and binding partners of SVH are currently unknown. See Huang R, Xing Z, Luan Z, Wu T, Wu X, Hu G. A specific splicing variant of SVH, a novel human armadillo repeat protein, is up-regulated in hepatocellular carcinomas. Cancer Res. 2003 Jul. 1; 63(13):3775-82 and Kurochkin I. V., Yonemitsu N., Funahashi S. I., Nomura H. ALEX1, a novel human armadillo repeat protein that is expressed differentially in normal tissues and carcinomas. Biochem. Biophys. Res. Commun., 280. 340-347, 2001.

HSPA8 (alias CPN60, GROEL, HSP60, HSP65, SPG13, HuCHA60) encodes a 61055 Da protein of 573 amino acids, Heat shock 60 kDa protein 1 (SEQ ID NO: 11) at chromosome 2 (2q33.1). Representative nucleotide sequence NM_002156 (SEQ ID NO: 12). This gene encodes a member of the chaperonin family. The encoded mitochondrial protein may function as a signaling molecule in the innate immune system (Zanin-Zhorov et al. 2006). This protein is essential for the folding and assembly of newly imported proteins in the mitochondria. May also prevent misfolding and promote the refolding and proper assembly of unfolded polypeptides generated under stress conditions in the mitochondrial matrix (Jindal et al. 1989; Venner et al. 1990). Mutations associated with this gene cause autosomal recessive spastic paraplegia 13. See Zanin-Zhorov, A., Cahalon, L., Tal, G., Margalit, R., Lider, O. and Cohen, I. R. Heat shock protein 60 enhances CD4+ CD25+ regulatory T cell function via innate TLR2 signaling J. Clin. Invest. 116 (7), 2022-2032 (2006) PMID: 16767222 and Venner, T. J., Singh, B. and Gupta, R. S. Nucleotide sequences and novel structural features of human and Chinese hamster hsp60 (chaperonin) gene families DNA Cell Biol. 9 (8), 545-552 (1990) PMID: 1980192 and Jindal, S., Dudani, A. K., Singh, B., Harley, C. B. and Gupta, R. S. Primary structure of a human mitochondrial protein homologous to the bacterial and plant chaperonins and to the 65-kilodalton mycobacterial antigen Mol. Cell. Biol. 9 (5), 2279-2283 (1989) PMID:2568584.

YTHDC2 (alias DKFZp564A186, FLJ10053, FLJ2194) encodes a 160363 Da protein of 1430 amino acids, YTH domain containing 2 (SEQ ID NO: 13) at chromosome 5 (5q22.2). Representative nucleotide sequence NM_022828 (SEQ ID NO: 14). Gene function is currently unknown. Protein function analysis indicates ankyrin repeats (ankyrin repeats mediate protein-protein interactions in very diverse families of proteins), helicase superfamily c-terminal domain (this domain is found in a wide variety of helicases and helicase related proteins; all helicases share the ability to unwind nucleic acid duplexes with a distinct directional polarity).

CCT5 (alias CCTE, KIAA0098, CCT-epsilon, TCP-1-epsilon; CCT5) is a 59671 Da of 541 amino acids, Chaperonin containing TCP1, subunit 5 (SEQ ID NO:15) on chromosome 5 (5p15.2). Representative nucleotide sequence NM_012073 (SEQ ID NO: 16). This gene encodes a molecular chaperone that is member of the chaperonin containing TCP1 complex (CCT), also known as the TCP1 ring complex (TRiC; Kubota et al. 1994). This complex consists of two identical stacked rings, each containing eight different proteins (Roobol et al. 1995; Liou et al. 1997). Unfolded polypeptides enter the central cavity of the complex and are folded in an ATP-dependent manner. The complex folds various proteins, including actin and tubulin. See Liou, A. K. and Willison, K. R. Elucidation of the subunit orientation in CCT (chaperonin containing TCP1) from the subunit composition of CCT5 micro-complexes EMBO J. 16 (14), 4311-4316 (1997) PMID:9250675 and Roobol, A., Holmes, F. E., Hayes, N. V., Baines, A. J. and Carden, M. J. Cytoplasmic chaperonin complexes enter neurites developing in vitro and differ in subunit composition within single cells J. Cell. Sci. 108 (PT 4), 1477-1488 (1995) PMID:7615668 and Kubota, H., Hynes, G., Carne, A., Ashworth, A. and Willison, K. Identification of six Tcp-1-related genes encoding divergent subunits of the TCP-1-containing chaperonin Curr. Biol. 4 (2), 89-99 (1994).

KIAA0196 (alias SPG8, MGC111053 hypothetical protein LOC9897) encodes a 134286 Da protein, Strumpellin, of 1159 amino acids encoded on chromosome 8 (8p22) (SEQ ID NO: 17). Representative nucleotide sequence NM_014846 (SEQ ID NO:18). Gene function is currently unknown. Strumpellin was recently associated with hereditary spastic paraplegia (HSP) is a progressive upper-motor neurodegenerative disease (Valdmanis et al. 2007). See Valdmanis P N, Meijer I A, Reynolds A, Lei A, Macleod P, Schlesinger D, Zatz M, Reid E, Dion P A, Drapeau P, Rouleau G A. Mutations in the KIAA0196 Gene at the SPG8 Locus Cause Hereditary Spastic Paraplegia. Am J Hum Genet. 2007 January; 80(1):152-61. Epub 2006 Dec. 1. PMID: 17160902.

INADL (Alias Cipp, PATJ, FLJ26982) encodes a 196386 Da protein of 1801 amino acids, INAD-Like protein (SEQ ID NO: 19) on chromosome 1 (1p31.3). Reference nucleotide sequence NM_176878 (SEQ ID NO: 20). This gene encodes a protein with multiple PDZ domains. PDZ domains mediate protein-protein interactions, and proteins with multiple PDZ domains often organize multimeric complexes at the plasma membrane (Kurschner et al. 1998; Vaccaro et al. 2001). INADL is membrane associated, the protein localizes to tight junctions and to the apical membrane of epithelial cells (Michel et al. 2005). A similar protein in Drosophila is a scaffolding protein which tethers several members of a multimeric signaling complex in photoreceptors. Alternative splicing results in four transcript variants encoding different isoforms. See Michel, D., Arsanto, J. P., Massey-Harroche, D., Beclin, C., Wijnholds, J. and Le Bivic, A. PATJ connects and stabilizes apical and lateral components of tight junctions in human intestinal cells J. Cell. Sci. 118 (PT 17), 4049-4057 (2005) PMID: 16129888 and Kurschner, C., Mermelstein, P. G., Holden, W. T. and Surmeier, D. J. CIPP, a novel multivalent PDZ domain protein, selectively interacts with Kir4.0 family members, NMDA receptor subunits, neurexins, and neuroligins Mol. Cell. Neurosci. 11 (3), 161-172 (1998) PMID: 9647694 and Vaccaro, P., Brannetti, B., Montecchi-Palazzi, L., Philipp, S., Helmer Citterich, M., Cesareni, G. and Dente, L. Distinct binding specificity of the multiple PDZ domains of INADL, a human protein with homology to INAD from Drosophila melanogaster J. Biol. Chem. 276 (45), 42122-42130 (2001).

TPR encodes a 265601 Da protein of 2349 amino acids, Nucleoprotein TPR (SEQ ID NO: 21) on chromosome 1 (Entrez Gene cytogenetic band: 1q25). Reference nucleotide sequence NM_003292 (SEQ ID NO: 22). This gene encodes a large coiled-coil protein that forms intranuclear filaments attached to the inner surface of nuclear pore complexes (NPCs). The protein directly interacts with several components of the NPC (Hase et al. 2003; Krull et al. 2004). It is required for the nuclear export of mRNAs and some proteins. Oncogenic fusions of the 5' end of this gene with several different kinase genes occur in some neoplasias (Gonzatti-Haces et al. 1988). See Hase, M. E. and Cordes, V. C. Direct interaction with nup153 mediates binding of Tpr to the periphery of the nuclear pore complex Mol. Biol. Cell 14 (5), 1923-1940 (2003) PMID:12802065 and Krull, S., Thyberg, J., Bjorkroth, B., Rackwitz, H. R. and Cordes, V. C. Nucleoporins as components of the nuclear pore complex core structure and Tpr as the architectural element of the nuclear basket Mol. Biol. Cell 15 (9), 4261-4277 (2004) PMID: 15229283 and Gonzatti-Haces, M., Seth, A., Park, M., Copeland, T., Oroszlan, S, and Vande Woude, G. F. Characterization of the TPR-MET oncogene p65 and the MET protooncogene p140 protein-tyrosine kinases Proc. Natl. Acad. Sci. U.S.A. 85 (1), 21-25 (1988). PMID:3277171

SAS10 (alias charged amino acid-rich leucine zipper 1) is a 54558 Da protein of 479 amino acids, Something about silencing protein 10 (SEQ ID NO: 23) on chromosome 4 (Entrez Gene cytogenetic band: 4q13.3). Reference nucleotide sequence NM_020368 (SEQ ID NO: 24). Function of the protein is unknown, by similarity it appears to have a role in gene silencing by alteration of the structure of silenced chromatin and may play a role in the developing brain (Kamakaka et al. 1998; Peters et al. 2003). See Peters N T, Rohrbach J A, Zalewski B A, Byrkett C M, Vaughn J C. RNA editing and regulation of Drosophila 4f-rnp expression by sas-10 antisense readthrough mRNA transcripts. RNA. 2003 June; 9(6):698-710. PMID: 12756328 and Kamakaka R T, Rine J. Sir- and silencer-independent disruption of silencing in Saccharomyces by Sas10p. Genetics. 1998 June; 149(2): 903-14 PMID: 9611201

ECH1 (alias EC 5.3.3, HPXEL, Delta-3,5-delta-2,4-dienoyl-CoA isomerase, mitochondrial precursor, enoyl Coenzyme A hydratase 1 peroxisomal) encodes a 35816 Da protein of 328 amino acids, Delta(3,5)-Delta(2,4)-dienoyl-CoA isomerase, mitochondrial (SEQ ID NO: 25) on chromosome 19 (Entrez Gene cytogenetic band: 19q13.1). Representative nucleotide sequence NM_001398 (SEQ ID NO: 26). This protein is a member of the hydratase/isomerase superfamily. The gene product shows high sequence similarity to enoyl-coenzyme A (CoA) hydratases of several species, particularly within a conserved domain characteristic of these proteins. The encoded protein, which contains a C-terminal peroxisomal targeting sequence, localizes to the peroxisome. The rat ortholog, which localizes to the matrix of both the peroxisome and mitochondria, can isomerize 3-trans,5-cis-dienoyl-CoA to 2-trans,4-trans-dienoyl-CoA, indicating that it is a delta-3,5-delta-2,4-dienoyl-CoA isomerase. This enzyme functions in the auxiliary step of the fatty acid beta-oxidation pathway (Filppula et al. 1998). See Filppula, S. A., Yagi, A. I., Kilpelainen, S. H., Novikov, D., FitzPatrick, D. R., Vihinen, M., Valle, D. and Hiltunen, J. K. Delta-3,5-delta-2,4-dienoyl-CoA isomerase from rat liver. Molecular characterization. J. Biol. Chem. 273 (1), 349-355 (1998). PMID 9417087

HSPA8 (alias: LAP1, HSC54, HSC70, HSC71, HSP71, HSP73, NIP71, HSPA10, MGC29929) encodes a 70898 Da protein of 646 amino acids, Heat shock cognate 71 kDa protein (SEQ ID NO: 27) on chromosome 11 (Entrez Gene cytogenetic band: 11q24.1). Representative nucleotide sequence NM_006597/153201 (SEQ ID NO:28). This gene encodes a heat-shock cognate protein. This protein binds to nascent polypeptides to facilitate correct folding. It also functions as an ATPase in the disassembly of clathrin-coated vesicles during transport of membrane components through the cell (Dworniczak et al. 1987; DeLuca-Flatherty et al. 1990). Two alternatively spliced variants have been characterized to date. Interacts with HSPH1/HSP105 (By similarity). Interacts with PACRG. Found in the cytoplasm. Translocates rapidly from the cytoplasm to the nuclei, and especially to the nucleoli, upon heat shock. See Dworniczak, B. and Mirault, M. E. Structure and expression of a human gene coding for a 71 kd heat shock 'cognate' protein. Nucleic Acids Res. 15 (13), 5181-5197 (1987) PMID: 3037489 and DeLuca-Flaherty, C., McKay, D. B., Parham, P. and Hill, B. L. Uncoating protein (hsc70) binds a conformationally labile domain of clathrin light chain LCa to stimulate ATP hydrolysis. Cell 62 (5), 875-887 (1990). PMID: 1975516

MUT (alias EC 5.4.99.2, MCM, Methylmalonyl-CoA isomerase) encodes a 83120 Da protein of 750 amino acids, Methylmalonyl-CoA mutase, mitochondrial (SEQ ID NO: 29) on chromosome 6 (Entrez Gene cytogenetic band: 6p21). Representative nucleotide sequence NM_000255 (SEQ ID NO: 30). The protein is located in the mitochondrial matrix MUT is a vitamin B12-dependent enzyme which catalyzes the isomerization of methylmalonyl-CoA to succinyl-CoA (Padovani et al. 2006). Defects in MUT are the cause of methylmalonicaciduria due to methylmalonyl-CoA mutase deficiency (MMA) [MIM:251000]. MMA is an often fatal disorder of organic acid metabolism. See Padovani, D., Labunska, T. and Banerjee, R. Energetics of interaction between the G-protein chaperone, MeaB, and B12-dependent methylmalonyl-CoA mutase. J. Biol. Chem. 281 (26), 17838-17844 (2006). PMID: 16641088

LSM3 (alias: SMX4, USS2, YLR438C) encodes a 11714 Da protein of 101 amino acids, U6 snRNA-associated Sm-like protein (SEQ ID NO: 31) on chromosome 3 (Entrez Gene cytogenetic band: 3p25.1). Representative nucleotide sequence NM_014463 (SEQ ID NO: 32). LSM3 is a member of the Sm-like proteins that contain the Sm sequence motif, which consists of 2 regions separated by a linker of variable length that folds as a loop. The Sm-like proteins are thought to form a stable heteromer present in tri-snRNP particles, which are important for pre-mRNA splicing (Achsel et al. 1999). See Achsel, T., Brahms, H., Kastner, B., Bachi, A., Wilm, M. and Luhrmann, R. A doughnut-shaped heteromer of human Sm-like proteins binds to the 3'-end of U6 snRNA, thereby facilitating U4/U6 duplex formation in vitro. EMBO J. 18 (20), 5789-5802 (1999). PMID 10523320.

DLAT (alias: DLTA, PDCE2, PDC-E2614) encodes a 65781 Da protein of 614 amino acids, Dihydrolipoyllysine-residue acetyltransferase component of pyruvate dehydrogenase complex (SEQ ID NO: 33) on chromosome 11 (Entrez Gene cytogenetic band: 11q23.1). Representative nucleotide sequence NM_001931 (SEQ ID NO: 34). The DLAT gene encodes dihydrolipoamide acetyltransferase, the E2 subunit of the mammalian pyruvate dehydrogenase complex (PDC) of the inner mitochondrial membrane. The pyruvate dehydrogenase complex catalyzes the overall conversion of pyruvate to acetyl-CoA and CO(2). It contains multiple copies of three enzymatic components: pyruvate dehydrogenase (E1), dihydrolipoamide acetyltransferase (E2) and lipoamide dehydrogenase (E3; Hiromasa et al. 2004). See Hiromasa, Y., Fujisawa, T., Aso, Y. and Roche, T. E. Organization of the cores of the mammalian pyruvate dehydrogenase complex formed by E2 and E2 plus the E3-binding protein and their capacities to bind the E1 and E3 components. J. Biol. Chem. 279 (8), 6921-6933 (2004). PMID: 14638692.

HYPK (alias: HSPC136, 4F5rel, FAM2C, h4F5rel) encodes a 14776 Da protein of 129 amino acids Huntingtin-interacting protein K (SEQ ID NO: 35) on chromosome 15 (Entrez Gene cytogenetic band: 15q15.3). Representative nucleotide sequence NM_016400 (SEQ ID NO: 36). Function of the gene/protein is unknown. Interaction with Huntingtin (Faber et al. 1998) and association as a candidate modifying gene for spinal muscular atrophy (Scharf et al. 1998) are suggested for HYPK. See Faber P W, Barnes G T, Srinidhi J, Chen J, Gusella J F, MacDonald M E. Huntingtin interacts with a family of WW domain proteins. Hum Mol. Genet. 1998 September; 7(9):1463-74 PMID: 9700202 and Scharf J M, Endrizzi M G, Wetter A, Huang S, Thompson T G, Zerres K, Dietrich W F, Wirth B, Kunkel L M. Identification of a candidate modifying gene for spinal muscular atrophy by comparative genomics. Nat. Genet. 1998 September; 20(1):83-6. PMID: 9731538.

NME1 (alias AWD, GAAD, NM23, NDPKA, NM23-H1) encodes a 17149 Da protein of 152 amino acids, Nucleoside diphosphate kinase A (SEQ ID NO: 37) on chromosome 17 (Entrez Gene cytogenetic band: 17q21.3). Representative nucleotide sequence NM_000269/198175 (SEQ ID NO: 38). This protein is a member of the nucleoside diphosphate kinase gene family, involved in the phosphorylation of nucleoside diphosphates. This gene (NME1) was identified because of its reduced mRNA transcript levels in highly metastatic cells (Rosengard et al. 1989). Nucleoside diphosphate kinase (NDK) exists as a hexamer composed of 'A' (encoded by this gene) and 'B' (encoded by NME2) isoforms (Gilles et al. 1991). Two transcript variants encoding different isoforms have been found for this gene (thus NM_000269/198175). Co-transcription of this gene and the neighboring downstream gene (NME2) generates naturally-occurring transcripts (NME1-NME2), which encodes a fusion protein comprised of sequence sharing identity with each individual gene product. See Gilles, A. M., Presecan, E., Vonica, A. and Lascu, I. Nucleoside diphosphate kinase from human erythrocytes. Structural characterization of the two polypeptide chains responsible for heterogeneity of the hexameric enzyme. J. Biol. Chem. 266 (14), 8784-8789 (1991). PMID 1851158 and Rosengard, A. M., Krutzsch, H. C., Sheam, A., Biggs, J. R., Barker, E., Margulies, I. M., King, C. R., Liotta, L. A. and Steeg, P. S. Reduced Nm23/Awd protein in tumor metastasis and aberrant *Drosophila* development. Nature 342 (6246), 177-180 (1989). PMID 2509941.

KIAA0310 (alias RP11-413M3.10) encodes a 233517 Da protein of 2179 amino acids, SEC16 homolog A (SEQ ID NO: 39) on chromosome 9 (Entrez Gene cytogenetic band: 9q34.3). Representative nucleotide sequence XM_946064)

(SEQ ID NO: 40). No publications outline function, location or partners for interaction—unknown.

EIF3S9 (alias PRT1, eIF3b, EIF3-ETA, EIF3-P110, EIF3-P116, MGC104664, MGC131875) encodes a 92492 Da protein of 814 amino acids, Eukaryotic translation initiation factor 3 subunit B (SEQ ID NO: 41) on chromosome 7 (Entrez Gene cytogenetic band: 7p22.2). Representative nucleotide sequence NM_001037283 (SEQ ID NO: 42). EIF3S9 encodes a protein that is one subunit of the eIF3 mammalian transcription factors (composed of at least 12 different subunits). eIF-3 is the largest of the mammalian translation initiation factors consisting of subunits ranging in mass from 35 to 170 kDa (Chaudhuri et al. 1997). eIF3 binds to the 40 S ribosome in an early step of translation initiation and promotes the binding of methionyl-tRNAi and mRNA. eIF3 also functions as a ribosome subunit anti-association factor (Asano et al. 1997; Methot et al. 1997) See Chaudhuri, J., Chakrabarti, A. and Maitra, U. Biochemical characterization of mammalian translation initiation factor 3 (eIF3). Molecular cloning reveals that p110 subunit is the mammalian homologue of Saccharomyces cerevisiae protein Prt1. J. Biol. Chem. 272 (49), 30975-30983 (1997) PMID 9388245 and Methot, N., Rom, E., Olsen, H. and Sonenberg, N. The human homologue of the yeast Prt1 protein is an integral part of the eukaryotic initiation factor 3 complex and interacts with p170 J. Biol. Chem. 272 (2), 1110-1116 (1997) PMID 8995410 and Asano, K., Kinzy, T. G., Merrick, W. C. and Hershey, J. W. Conservation and diversity of eukaryotic translation initiation factor eIF3. J. Biol. Chem. 272 (2), 1101-1109 (1997). PMID 8995409

ACAT2 (alias ACTL EC 2.3.1.9 Acetyl CoA transferase-like protein Acetyl-CoA acetyltransferase, Cytosolic acetoacetyl-CoA thiolase) encodes a 41351 Da 397 amino acids, Acetyl-Coenzyme A acetyltransferase 2 (SEQ ID NO: 43) on chromosome 6 (Entrez Gene cytogenetic band: 6q25.3-q26) Representative nucleotide sequence NM_005891 (SEQ ID NO: 44). Acetyl-Coenzyme A acetyltransferase 2 is an enzyme involved in lipid metabolism (Liu et al. 2005; An et al. 2006). Reported patients with ACAT2 deficiency have shown severe mental retardation and hypotonus (Bennet et al. 1984). The ACAT2 gene shows complementary overlapping with the 3-prime region of the TCP1 gene in both mouse and human. These genes are encoded on opposite strands of DNA, as well as in opposite transcriptional orientation. See An, S., Cho, K. H., Lee, W. S., Lee, J. O., Paik, Y. K. and Jeong, T. S. A critical role for the histidine residues in the catalytic function of acyl-CoA:cholesterol acyltransferase catalysis: evidence for catalytic difference between ACAT1 and ACAT2. Lett. 580 (11), 2741-2749 (2006) PMID 16647063 and Liu, J., Chang, C. C., Westover, E. J., Covey, D. F. and Chang, T. Y. Investigating the allosterism of acyl-CoA:cholesterol acyltransferase (ACAT) by using various sterols: in vitro and intact cell studies Biochem. J. 391 (PT 2), 389-397 (2005) PMID 15992359 and Bennett, M. J., Hosking, G. P., Smith, M. F., Gray, R. G. and Middleton, B. Biochemical investigations on a patient with a defect in cytosolic acetoacetyl-CoA thiolase, associated with mental retardation. J. Inherit. Metab. Dis. 7 (3), 125-128 (1984). PMID 6150136

PSMD2 (alias S2, P97, TRAP2, MGC14274) encodes a 100200 Da protein of 908 amino acids, 26S proteasome non-ATPase regulatory subunit 2 (SEQ ID NO: 45) on chromosome 3 (Ensembl cytogenetic band: 3q27.1). Representative nucleotide sequence NM_002808 (SEQ ID NO: 46). PSMD2 acts as a regulatory subunit of the 26 proteasome which is involved in the ATP-dependent degradation of ubiquitinated proteins (Coux et al. 1996). An essential function of a modified proteasome, the immunoproteasome, is the processing of class I MHC peptides. In addition to participation in proteasome function, this subunit may also participate in the TNF signaling pathway since it interacts with the tumor necrosis factor type 1 receptor (Tsurumi et al. 1996; Song and Donner 1995) See Tsurumi, C., Shimizu, Y., Saeki, M., Kato, S., Demartino, G. N., Slaughter, C. A., Fujimuro, M., Yokosawa, H., Yamasaki, M., Hendil, K. B., Toh-e, A., Tanahashi, N. and Tanaka, K. cDNA cloning and functional analysis of the p97 subunit of the 26S proteasome, a polypeptide identical to the type-1 tumor-necrosis-factor-receptor-associated protein-2/55.11 Eur. J. Biochem. 239 (3), 912-921 (1996) PMID: 8774743 and Coux, O., Tanaka, K. and Goldberg, A. L. Structure and functions of the 20S and 26S proteasomes Annu. Rev. Biochem. 65, 801-847 (1996) PMID: 8811196 and Song, H. Y. and Donner, D. B. Association of a RING finger protein with the cytoplasmic domain of the human type-2 tumor necrosis factor receptor Biochem. J. 309 (PT 3), 825-829 (1995). PMID: 7639698

KNTC2 (alias: HEC, HEC 1) encodes a 73913 Da of 642 amino acids, Kinetochore associated 2 (SEQ ID NO: 47) on chromosome 18 (Ensembl cytogenetic band: 18p11.32). Representative nucleotide sequence NM_006101 (SEQ ID NO: 48). The protein encoded by KNTC2 is one of several proteins involved in spindle checkpoint signaling (Ciferri et al. 2005). This surveillance mechanism assures correct segregation of chromosomes during cell division by detecting unaligned chromosomes and causing prometaphase arrest until the proper bipolar attachment of chromosomes is achieved (DeLuca et al. 2006). Interacts with the regulatory subunit of the 26 S proteasome (Chen et al. 1997). See DeLuca, J. G., Gall, W. E., Ciferri, C., Cimini, D., Musacchio, A. and Salmon, E. D. Kinetochore microtubule dynamics and attachment stability are regulated by Hec1 Cell 127 (5), 969-982 (2006) 17129782 and Ciferri, C., De Luca, J., Monzani, S., Ferrari, K. J., Ristic, D., Wyman, C., Stark, H., Kilmartin, J., Salmon, E. D. and Musacchio, A. Architecture of the human ndc80-hec1 complex, a critical constituent of the outer kinetochore J. Biol. Chem. 280 (32), 29088-29095 (2005) PMID: 15961401 and Chen, Y., Sharp, Z. D. and Lee, W. H. HEC binds to the seventh regulatory subunit of the 26 S proteasome and modulates the proteolysis of mitotic cyclins J. Biol. Chem. 272 (38), 24081-24087 (1997). PMID: 9295362

ICF45 (alias tRNA-histidine guanylyltransferase 1-like (THG1L), FLJ11601, FLJ20546) encodes a 20157 Da protein of 173 amino acids, Interphase cyctoplasmic foci protein 45 (SEQ ID NO: 49) on chromosome 5 (Ensembl cytogenetic band: 5q33.3) Representative nucleotide sequence NM_017872 (SEQ ID NO: 50). ICF45 is a highly conserved protein, which is expressed in a cell cycle-dependent manner and seemed to be involved in cell cycle progression and cell proliferation (Guo et al. 2004). Function/activity currently unknown. See Guo, D., Hu, K., Lei, Y., Wang, Y., Ma, T. and He, D. Identification and characterization of a novel cytoplasm protein ICF45 that is involved in cell cycle regulation J. Biol. Chem. 279 (51), 53498-53505 (2004). PMID: 15459185

RIF1 (alias RAP1 interacting factor homolog (yeast), FLJ12870, DKFZp781N1478) encodes 274466 Da protein of 2472 amino acids, RAP1 interacting factor homolog (SEQ ID NO: 51) on chromosome 2 (Ensembl cytogenetic band: 2q23.3). Representative nucleotide sequence NM_018151 (SEQ ID NO: 52). Found in the nucleus. Exhibits ATM- and TP53BP1-dependent localization to uncapped or aberrant telomeres and to DNA double strand breaks (Xu and Blackburn 2004; Silverman et al. 2004). Does not associate with normal telomere structures. Localizes to microtubules of the midzone of the mitotic spindle during anaphase, and to condensed chromosomes in telophase. Expression peaks in late G2/S phase of the cell cycle. Required for checkpoint mediated arrest of cell cycle progression in response to DNA damage during S-phase (the intra-S-phase checkpoint). See Xu, L. and Blackburn, E. H. Human Rif1 protein binds aberrant telomeres and aligns along anaphase midzone microtubules. J. Cell Biol. 167 (5), 819-830 (2004). PMID:15583028 and Silverman, J., Takai, H., Buonomo, S. B., Eisenhaber, F. and de Lange, T. Human Rif1, ortholog of a yeast telomeric protein, is regulated by ATM and 53BP1 and functions in the S-phase checkpoint. Genes Dev. 18 (17), 2108-2119 (2004). PMID:15342490

MPHOSPH10 (alias U3 small nucleolar ribonucleoprotein, MPP10, MPP10P) encodes a 78864 Da protein of 681 amino acids, M-phase phosphoprotein 10 (SEQ ID NO: 53) on chromosome 2 (Ensembl cytogenetic band: 2p13.3). Representation nucleotide sequence NM_005791 (SEQ ID NO: 54). This gene encodes a protein that is phosphorylated during mitosis. The protein localizes to the nucleolus during interphase and to the chromosomes during M phase. The protein is thought to be part of the U3 small nucleolar ribonucleoprotein complex, which is involved in rRNA processing (Westendorf et al. 1998). Component of a heterotrimeric complex containing IMP3, IMP4 and MPHOSPH10 (Granneman et al. 2003). See Granneman, S., Gallagher, J. E., Vogelzangs, J., Horstman, W., van Venrooij, W. J., Baserga, S. J. and Pruijn, G. J. The human Imp3 and Imp4 proteins form a ternary complex with hMpp10, which only interacts with the U3 snoRNA in 60-80S ribonucleoprotein complexes. Nucleic Acids Res. 31 (7), 1877-1887 (2003). PMID: 12655004 and Westendorf J. M., Konstantinov, K. N., Wormsley, S., Shu, M. D., Matsumoto-Taniura, N., Pirollet, F., Klier, F. G., Gerace, L. and Baserga, S. J. M phase phosphoprotein 10 is a human U3 small nucleolar ribonucleoprotein component. Mol. Biol. Cell 9 (2), 437-449 (1998). PMID: 9450966.

TAOK3 (alias DPK, JIK, MAP3K18, FLJ31808, DKFZp666H245) encodes a 105406 Da protein of 898 amino acids, TAO Kinase 3 (SEQ ID NO: 55 on chromosome 12 (Ensembl cytogenetic band: 12q24.23). Representative nucleotide sequence NM_016281 (SEQ ID NO: 56). Located in cytoplasm. Also localized to the peripheral cell membrane. Inhibits the basal activity of Jun kinase (Tassi et al. 1999). Negatively regulated by epidermal growth factor (EGF) (Zhang et al. 2000). See Zhang, W., Chen, T., Wan, T., He, L., Li, N., Yuan, Z. and Cao, X. Cloning of DPK, a novel dendritic cell-derived protein kinase activating the ERK1/ERK2 and JNK/SAPK pathways. Biochem. Biophys. Res. Commun. 274 (3), 872-879 (2000). PMID: 10924369 and Tassi, E., Biesova, Z., Di Fiore, P. P., Gutkind, J. S, and Wong, W. T. Human JIK, a novel member of the STE20 kinase family that inhibits JNK and is negatively regulated by epidermal growth factor J. Biol. Chem. 274 (47), 33287-33295 (1999). PMID: 10559204

UBTF (alias UBF, NOR-90) encodes a 764 amino acid protein of 89406 Da, Nucleolar transcription factor 1 (SEQ ID NO: 57) on chromosome 17 (Ensembl cytogenetic band: 17q21.31). Representative nucleotide sequence NM_014233) (SEQ ID NO: 58). Upstream binding factor (UBF) is a transcription factor required for expression of the 18S, 5.8S, and 28S ribosomal RNAs, along with SL1 (a complex of TBP) and multiple TBP-associated factors or 'TAFs'). Two UBF polypeptides, of 94 and 97 kD, exist in the human (Bell et al., 1988; Voit et al. 1995). UBF is a nucleolar phosphoprotein with both DNA binding and transactivation domains. Sequence-specific DNA binding to the core and upstream control elements of the human rRNA promoter is mediated through several HMG boxes (Jantzen et al. 1990). See Bell, S. P., Learned, R. M., Jantzen, H. M. and Tjian, R. Functional cooperativity between transcription factors UBF1 and SL1 mediates human ribosomal RNA synthesis. Science 241 (4870), 1192-1197 (1988). PMID: 3413483 and Jantzen, H. M., Admon, A., Bell, S. P. and Tjian, R. Nucleolar transcription factor hUBF contains a DNA-binding motif with homology to HMG proteins. Nature 344 (6269), 830-836 (1990). PMID: 2330041 and Voit, R., Kuhn, A., Sander, E. E. and Grummt, I. Activation of mammalian ribosomal gene transcription requires phosphorylation of the nucleolar transcription factor UBF. Nucleic Acids Res. 23 (14), 2593-2599 (1995). PMID:

JARID1A (alias RBP2, RBBP2) encodes a 1722 amino acid protein of 195816 Da, Histone demethylase JARID1A (SEQ ID NO: 59) on chromosome 12 (Ensembl cytogenetic band: 12p13.33). Representative nucleotide sequence NM_001042603 (SEQ ID NO: 60). The protein encoded by this gene is a ubiquitously expressed nuclear protein. It binds directly, with several other proteins, to retinoblastoma protein which regulates cell proliferation (Fattaey et al. 1993; Defeo et al. 1991). This protein also interacts with rhombotin-2 which functions distinctly in erythropoiesis and in T-cell leukemogenesis (Mao et al. 1997). Rhombotin-2 is thought to either directly affect the activity of the encoded protein or may indirectly modulate the functions of the retinoblastoma protein by binding to this protein. Alternatively spliced transcript variants encoding distinct isoforms have been found for this gene. See Fattaey, A. R., Helin, K., Dembski, M. S., Dyson, N., Harlow, E., Vuocolo, G. A., Hanobik, M. G., Haskell, K. M., Oliff, A., Defeo-Jones, D. et al. Characterization of the retinoblastoma binding proteins RBP1 and RBP2. Oncogene 8 (11), 3149-3156 (1993). PMID: 8414517 and Defeo-Jones, D., Huang, P. S., Jones, R. E., Haskell, K. M., Vuocolo, G. A., Hanobik, M. G., Huber, H. E. and Oliff, A. Cloning of cDNAs for cellular proteins that bind to the retinoblastoma gene product. Nature 352 (6332), 251-254 (1991). PMID: 1857421 and Mao, S., Neale, G. A. and Goorha, R. M. T-cell oncogene rhombotin-2 interacts with retinoblastoma-binding protein 2. Oncogene 14 (13), 1531-1539 (1997). PMID: 9129143

ROCK 2 (alias KIAA0619) is a gene encoding a 160913 Da protein of 1388 amino acids, Rho-associated protein kinase 2 (SEQ ID NO: 61) on chromosome 2 (Ensembl cytogenetic band: 2p25.1). Representative nucleotide sequence NM_004850 (SEQ ID NO: 62). ROCK2 is a protein serine/threonine kinase that phosphorylates a large number of important signaling proteins, and thereby regulates the assembly of the actin cytoskeleton. It promotes the formation of stress fibers and of focal adhesion complexes (Seko et al. 2003; Trauger et al. 2002; Witke et al. 1998). Also regulates cytokinesis, smooth muscle contraction and the activation of the c-fos serum response element. This protein, which is an isozyme of ROCK1 is a target for the small GTPase Rho. See Seko, T., Ito, M., Kureishi, Y., Okamoto, R., Moriki, N., Onishi, K., Isaka, N., Hartshorne, D. J. and Nakano, T. Activation of RhoA and inhibition of myosin phosphatase as important components in hypertension in vascular smooth muscle. Circ. Res. 92 (4), 411-418 (2003). PMID: 12600888 and Witke, W., Podtelejnikov, A. V., Di Nardo, A., Sutherland, J. D., Gurniak, C. B., Dotti, C. and Mann, M. In mouse brain profilin I and profilin II associate with regulators of the endocytic pathway and actin assembly. EMBO J. 17 (4), 967-976 (1998). PMID: 9463375 and Trauger, J. W., Lin, F. F., Turner, M. S., Stephens, J. and LoGrasso, P. V. *Kinetic* mechanism for human Rho-Kinase II (ROCK-II). Biochemistry 41 (28), 8948-8953 (2002). PMID: 12102637

GOLGB1 (alias golgi autoantigen, golgin subfamily b, macrogolgin (with transmembrane signal), 1 GCP, GCP372, GIANTIN) encodes a 376077 Da protein of 3259 amino acids, Golgin subfamily B member 1 (SEQ ID NO: 63) on chromosome 3 (Ensembl cytogenetic band: 3q13.33). Representative nucleotide sequence NM_004487 (SEQ ID NO: 64). The GOLGB1 product is associated with the Golgi apparatus membrane as a single-pass type I membrane protein (Linstedt et al. 1993; Sohda et al. 1994). It is a disulfide-linked Homodimer that may participate in forming intercisternal cross-bridges of the Golgi complex (Sonnichsen et al. 1998). Protein is a target of autoantibodies in rheumatic and HIV infections (Seelig et al. 1994) See Seelig, H. P., Schranz, P., Schroter, H., Wiemann, C. and Renz, M. Macrogolgin—a new 376 kD Golgi complex outer membrane protein as target of antibodies in patients with rheumatic diseases and HIV infections. J. Autoimmun. 7 (1), 67-91 (1994). PMID: 8198703 and Linstedt, A. D. and Hauri, H. P. Giantin, a novel conserved Golgi membrane protein containing a cytoplasmic domain of at least 350 kDa. Mol. Biol. Cell 4 (7), 679-693 (1993). PMID: 7691276 and Sonnichsen, B., Lowe, M., Levine, T., Jamsa, E., Dirac-Svejstrup, B. and Warren, G. A role for giantin in docking COP1 vesicles to Golgi membranes. J. Cell Biol. 140 (5), 1013-1021 (1998). PMID: 9490716 and Sohda, M., Misumi, Y., Fujiwara, T., Nishioka, M. and Ikehara, Y. Molecular cloning and sequence analysis of a human 372-kDA protein localized in the Golgi complex. Biochem. Biophys. Res. Commun. 205 (2), 1399-1408 (1994). PMID: 7802676

PGAM5 (alias Bcl-XL-binding protein v68, MGC5352, BXLBv68, MGC5352) encodes a 28006 Da protein of 255 amino acids, Phosphoglycerate mutase family member 5 (SEQ ID NO: 65) on chromosome 12 (Ensembl cytogenetic band: 12q24.33). Representative nucleotide sequence NM_138575 (SEQ ID NO: 66). PGAM5 is a member of the phosphoglycerate mutase super-family. In humans, the phosphoglycerate mutase superfamily consists of at least 10 distinct protein-encoding genes defined by the presence of the evolutionarily conserved PGAM domain (pfam00300). The PGAM5 gene encodes two protein isoforms, PGAM5-L and PGAM5-S, which result from alternative splicing. Both PGAM5 isoforms contain an N-terminal region of 100 amino acids, which includes a conserved NXESGE motif that is required for binding to Keap1, and a C-terminal phosphoglycerate mutase (PGAM) domain, which binds to Bcl-$X_L$. May have a role in regulation of T-cell receptor signaling and endocytosis of the receptor-tyrosine kinase (Hammond et al. 2001; Lo et al. 2006). See Hammond, P. W., Alpin, J., Rise, C. E., Wright, M. and Kreider, B. L. In vitro selection and characterization of Bcl-X(L)-binding proteins from a mix of tissue-specific mRNA display libraries. J. Biol. Chem. 276 (24), 20898-20906 (2001). PMID: 11283018 and Lo, S. C. and Hannink, M. PGAM5, a Bcl-XL-interacting Protein, Is a Novel Substrate for the Redox-regulated Keap1-dependent Ubiquitin Ligase Complex. J. Biol. Chem. 281 (49), 37893-37903 (2006). PMID: 17046835

MRPL32 (alias L32mt, HSPC283, MRP-L32, bMRP-59b) encodes a 21405 Da protein of 188 amino acids, Mitochondrial ribosomal protein L32 (SEQ ID NO: 67) on chromosome 7 (Ensembl cytogenetic band: 7p14.1). Representative nucleotide sequence NM_031903 (SEQ ID NO: 68). MRPL32 is a member of mammalian mitochondrial ribosomal proteins that are encoded by nuclear genes and help in protein synthesis within the mitochondrion. Mitochondrial ribosomes (mitoribosomes) consist of a small 28S subunit and a large 39S subunit. This gene encodes a 39S subunit protein that belongs to the L32 ribosomal protein family (Suzuki et al. 2001; Koc et al. 2001). See Suzuki, T., Terasaki, M., Takemoto-Hori, C., Hanada, T., Ueda, T., Wada, A. and Watanabe, K. Structural compensation for the deficit of rRNA with proteins in the mammalian mitochondrial ribosome. Systematic analysis of protein components of the large ribosomal subunit from mammalian mitochondria. J. Biol. Chem. 276 (24), 21724-21736 (2001). PMID: 11279069 and Koc, E. C., Burkhart, W., Blackburn, K., Moyer, M. B., Schlatzer, D. M., Moseley, A. and Spremulli, L. L. The large subunit of the mammalian mitochondrial ribosome. Analysis of the complement of ribosomal proteins present. J. Biol. Chem. 276 (47), 43958-43969 (2001). PMID: 11551941

KIF15 (alias HKLP2, KNSL7, FLJ25667, NY-BR-62) encodes a 160160 Da protein of 1388 amino acids, Kinesin family member 15 (SEQ ID NO: 69) on chromosome 3 (DaEnsembl cytogenetic band: 3p21.31). Representative nucleotide sequence NM_020242 (SEQ ID NO: 70). KIF15 is a human homolog of Xklp2 (Xenopus kinesin-like protein 2) identified by its interaction with Ki-67 (Sueishi et al. 2000). Xklp2 is a plus-end directed kinesin-like motor that has been reported to be required in centrosome separation and the maintenance of spindle bipolarity during mitosis in Xenopus egg extracts. See Sueishi, M., Takagi, M. and Yoneda, Y. The forkhead-associated domain of Ki-67 antigen interacts with the novel kinesin-like protein Hklp2. J. Biol. Chem. 275 (37), 28888-28892 (2000). PMID: 10878014

CENPF (alias mitosin, CENF, hcp-1, PRO1779) encodes a 367594 Da protein of 3210 amino acids, Centromere protein F (SEQ ID NO: 71) on chromosome 1 (Ensembl cytogenetic band: 1q41). Representative nucleotide sequence NM_016343 (SEQ ID NO: 72). The protein derived from CENPF associates with the centromere-kinetochore complex. The protein is a component of the nuclear matrix during the G2 phase of interphase. In late G2 the protein associates with the kinetochore and maintains this association through early anaphase (Liao et al. 1995). It localizes to the spindle midzone and the intracellular bridge in late anaphase and telophase, respectively, and is thought to be subsequently degraded. The localization of this protein suggests that it may play a role in chromosome segregation during mitotis (Feng et al. 2006; Bomont et al. 2005). It is thought to form either a homodimer or heterodimer. See Feng, J., Huang, H. and Yen, T. J. CENP-F is a novel microtubule-binding protein that is essential for kinetochore attachments and affects the duration of the mitotic checkpoint delay. Chromosoma 115 (4), 320-329 (2006). PMID: 16601978 and Bomont, P., Maddox, P., Shah, J. V., Desai, A. B. and Cleveland, D. W. Unstable microtubule capture at kinetochores depleted of the centromere-associated protein CENP-F. EMBO J. 24 (22), 3927-3939 (2005). PMID: 16252009 and Liao, H., Winkfein, R. J., Mack, G., Rattner, J. B. and Yen, T. J. CENP-F is a protein of the nuclear matrix that assembles onto kinetochores at late G2 and is rapidly degraded after mitosis. J. Cell Biol. 130 (3), 507-518 (1995). PMID: 7542657

Membrane-associated ring finger (C3HC4) 6 (alias TEB4, RNF176, KIAA0597, MARCH-VI) encodes a 72136 Da protein of 635 amino acids (SEQ ID NO: 73) encoded on chromosome 5 (Ensembl cytogenetic band: 5p15.2). Representative nucleotide sequence NM_005885 (SEQ ID NO: 74). MARCH6 encodes a human homology of the yeast Saccharomyces cerevisiae, ER-localized E3 ligase Doa10. Doa10 is a multispanning membrane protein that is a member of the RING family of E3s. Doa10 is thought to be a central component of the yeast ER stress response and ERAD pathways (Kreft et al. 2006; Bartee et al. 2004). See Kreft, S. G., Wang, L. and Hochstrasser, M. Membrane topology of the yeast endoplasmic reticulum-localized ubiquitin ligase Doa10 and comparison with its human ortholog TEB4 (MARCH-VI). J. Biol. Chem. 281 (8), 4646-4653 (2006). PMID: 16373356 and Bartee, E., Mansouri, M., Hovey Nerenberg, B. T., Gouveia, K. and Fruh, K. Downregulation of major histocompatibility complex class I by human ubiquitin ligases related to viral immune evasion proteins. J. Virol. 78 (3), 1109-1120 (2004). PMID: 14722266

CCDC46 (alias FLJ39610, MGC33887) encodes a 112749 Da protein of 955 amino acids, Coiled-coil domain containing 46 (SEQ ID NO: 75) on chromosome 17 (Ensembl cytogenetic band: 17q24.1). Representative nucleotide sequence NM_145036 (SEQ ID NO: 76). This gene encodes a protein with filament, myosin tail and ATPase domains. Orthologs of this gene exist in mouse, rat and chimp. Alternate transcriptional splice variants, encoding different isoforms, have been characterized (Harrington et al. 2001). See Harrington, J. J., Sherf, B., Rundlett, S., Jackson, P. D., Perry, R., Cain, S., et al. Creation of genome-wide protein expression libraries using random activation of gene expression. Nat. Biotechnol. 19 (5), 440-445 (2001). PMID: 11329013

RSN (alias CLIP, CYLN1, CLIP170, CLIP-170, MGC131604) encodes a 160990 Da protein of 1427 amino acids, Restin (SEQ ID NO: 77) on chromosome 12 (Ensembl cytogenetic band: 12q24.31). Representative nucleotide sequence NM_198240 (SEQ ID NO: 78). Restin seems to be a intermediate filament associated protein that links endocytic vesicles to microtubules. CLIP-170 is a microtubule 'plus end tracking' protein involved in several microtubule-dependent processes in interphase. At the onset of mitosis, CLIP-170 localizes to kinetochores, but at metaphase, it is no longer detectable at kinetochores (Pierre et al. 1992; 1994). Found in the Cytoplasm and Cytoskeleton. Restin is significantly overexpressed in the Reed-Sternberg cells of Hodgkin's patients (Bilbe et al. 1992). See Pierre, P., Scheel, J., Rickard, J. E. and Kreis, T. E. CLIP-170 links endocytic vesicles to microtubules. Cell 70 (6), 887-900 (1992). PMID: 1356075 and Bilbe, G., Delabie, J., Bruggen, J., Richener, H., Asselbergs, F. A., Cerletti, N., Sorg, C., Odink, K., Tarcsay, L., Wiesendanger, W. et al. Restin: a novel intermediate filament-associated protein highly expressed in the Reed-Sternberg cells of Hodgkin's disease. EMBO J. 11 (6), 2103-2113 (1992). PMID: 1600942 and Pierre, P., Pepperkok, R. and Kreis, T. E. Molecular characterization of two functional domains of CLIP-170 in vivo J. Cell. Sci. 107 (PT 7), 1909-1920 (1994). PMID: 7983157

CCDC18 (alias, dJ717123.1, RP4-717123.1) encodes a 41278Da protein of 362 amino acids, Coiled-coil domain containing 18 (SEQ ID NO: 79) on chromosome 1 (Ensembl cytogenetic band: 1p22.1. Representative nucleotide sequence NM_206886 (SEQ ID NO: 80). CCDC18 currently is unknown in terms of function and role (Leung et al. 1996). See Leung E, Print C G, Parry D A, Closey D N, Lockhart P J, Skinner S J, Batchelor D C, Krissansen G W. Cloning of novel kinectin splice variants with alternative C-termini: structure, distribution and evolution of mouse kinectin. Immunol Cell Biol. 1996 October; 74(5):421-33.

ACAA1 (alias peroxisomal 3-oxoacyl-Coenzyme A thiolase); synonyms: ACAA, THIO, PTHIO) encodes a 44929 Da protein of 424 amino acids, Acetyl-Coenzyme A acyltransferase 1 (SEQ ID NO: 81) on chromosome 3 (Ensembl cytogenetic band: 3p22.3). Representative nucleotide sequence NM_001607 (SEQ ID NO: 82). Acetyl-Coenzyme A acyltransferase (ACAA1) is an enzyme operative in the beta-oxidation system of the peroxisomes catalyzing Acyl-CoA+acetyl-CoA=CoA+3-oxoacyl-CoA. ACAA1 expression is markedly induced (at the level of transcription) by various hypolipidemic compounds in parallel with the other two enzymes of the peroxisomal beta-oxidation system Deficiency of this enzyme leads to pseudo-Zellweger syndrome (Schram et al. 1987). See Schram, A. W., Goldfischer, S., van Roermund, C. W., Brouwer-Kelder, E. M., Collins, J., Hashimoto, T., Heymans, H. S., van den Bosch, H., Schutgens, R. B., Tager, J. M. et al. Human peroxisomal 3-oxoacyl-coenzyme A thiolase deficiency. Proc. Natl. Acad. Sci. U.S.A. 84 (8), 2494-2496 (1987). PMID: 2882519

OTUB2 (alias::OTU domain, ubiquitin aldehyde binding 2, OUTB2, OTB2, OTU2, MGC3102, FLJ21916, C14orf137) encodes a 27213 Da protein, Ubiquitin thioesterase OTUB2 (SEQ ID NO: 83) of 234 amino acids on chromosome 14 (Ensembl cytogenetic band: 14q32.13). Representative nucleotide sequence NM_023112 (SEQ ID NO: 84). OUTB2 belongs to the otubain family of deubiquitylating cysteine proteases (that belong to the ovarian tumor (OTU) protein superfamily. Otubains cleave proteins precisely at the ubiquitin protein bond and can remove conjugated ubiquitin from proteins in vitro and may therefore play an important regulatory role at the level of protein turnover by preventing degradation (Balakirev et al. 2003). See Balakirev, M. Y., Tcherniuk, S. O., Jaquinod, M. and Chroboczek, J. Otubains: a new family of cysteine proteases in the ubiquitin pathway. EMBO Rep. 4 (5), 517-522 (2003).

FLJ14668 (alias Family with sequence similarity 136, member A, Protein FAM136A, hypothetical protein LOC84908) encodes is a 15641 Da protein (SEQ ID NO: 85) designated Family with sequence similarity 136, member A (NP_116211) of 138 amino acids on chromosome 2 (Ensembl cytogenetic band: 2p13.3). Representative nucleotide sequence NM_032822 (SEQ ID NO: 86). The protein sequence for FLJ14668 is most similar to the human Sm G protein, a "common protein" component of the snRNP. The region of greatest homology is within the Sm 1 and 2 motifs that characterize the protein members of the Sm group and it is therefore thought that LOC84908 bears some functional similarity, however, function and role are currently unknown (Lehner and Sanderson 2004: Simpson et al. 2000) See Lehner, B. and Sanderson, C. M. A protein interaction framework for human mRNA degradation. Genome Res. 14 (7), 1315-1323 (2004). PMID: 15231747 and Simpson, J. C., Wellenreuther, R., Poustka, A., Pepperkok, R. and Wiemann, S. Systematic subcellular localization of novel proteins identified by large-scale cDNA sequencing. EMBO Rep. 1 (3), 287-292 (2000)

HIGD2A (alias MGC2198) encodes a 11529 Da protein, HIG1 domain family, member 2A (reference NP_620175) of 106 amino acids (SEQ ID NO: 87) on chromosome 5 (Ensembl cytogenetic band: 5q35.2). Representative nucleotide sequence NM_138820 (SEQ ID NO: 88). Current function and role is unknown. Potentially encodes a multi-pass membrane protein (Strausberg et al. 2002). See Strausberg et al. Generation and initial analysis of more than 15,000 full-length human and mouse cDNA sequences. Proc. Natl. Acad. Sci. U.S.A. 99 (26), 16899-16903 (2002). PMID: 12477932

LOC51240 (alias ORM1 (*S. cerevisiae*)-like 2 (ORMDL2), MST095, HSPC160, MSTP095, adoplin-2) encodes a 17363 Da protein of 153 amino acids, ORM1 Like 2 (SEQ ID NO: 89) designated ORMDL2 (NP_054901) on chromosome 12 (Ensembl cytogenetic band: 12q13.2). Representative nucleotide sequence NM_014182 (SEQ ID NO: 90). LOC51240/ORMDL2 belongs to a novel gene family comprising three genes in humans (ORMDL1, ORMDL2 and ORMDL3), with homologs in yeast, microsporidia, plants, Drosophila, urochordates and vertebrates. The human genes are expressed ubiquitously in adult and fetal tissues. The ORMDL genes encode transmembrane proteins anchored in the endoplasmic reticulum (ER). Subcellular localization and the response of yeast mutants to specific agents point to the involvement of ORMDL in protein folding in the ER (Hjelmqvist et al. 2002) See Hjelmqvist, L., Tuson, M., Marfany, G., Herrero, E., Balcells, S, and Gonzalez-Duarte, R. ORMDL proteins are a conserved new family of endoplasmic reticulum membrane proteins. Genome Biol. 3 (6), RESEARCH0027 (2002). PMID: 12093374

NNAT (alias Peg5, MGC1439) encodes 2 different isoforms of Neuronatin—alpha (9237Da, 81 amino acids, SEQ ID NO: 91) and beta (6022 Da, 54 amino acids, SEQ ID NO: 92). The Beta (or #2) variant lacks an alternate in-frame exon compared to alpha (or #1) variant, resulting in an isoform that is shorter compared to isoform alpha. NNAT is encoded on chromosome 20 (Ensembl cytogenetic band: 20q11.23). Representative nucleotide sequence NM_005386 (transcript variant 1; SEQ ID NO: 93) and NM_181689 (transcript variant 2; SEQ ID NO: 94). Neuronatin is a proteolipid that may be involved in the regulation of ion channels during brain development (Duo and Joseph 1996a). The encoded protein may also play a role in forming and maintaining the structure of the nervous system, specifically in the segment identity in the hindbrain and pituitary development, and maturation or maintenance of the overall structure (Usui et al. 1997). This gene is found within an intron of the BLCAP gene, but on the opposite strand. This gene is imprinted and is expressed only from the paternal allele, while BLCAP is not imprinted. Abundant in 18-24 week old fetal brain. Postnatally its expression declines and only minimal levels are present in adulthood (Duo and Joseph 1996b). See Usui, H., Morii, K., Tanaka, R., Tamura, T., Washiyama, K., Ichikawa, T. and Kumanishi, T. cDNA cloning and mRNA expression analysis of the human neuronatin. High level expression in human pituitary gland and pituitary adenomas. J. Mol. Neurosci. 9 (1), 55-60 (1997). PMID: 9356927 and Dou, D. and Joseph, R. Cloning of human neuronatin gene and its localization to chromosome-20q11.2-12: the deduced protein is a novel 'proteolipid' Brain Res. 723 (1-2), 8-22 (1996a). PMID: 8813377 and Dou, D. and Joseph, R. Structure and organization of the human neuronatin gene Genomics 33 (2), 292-297 (1996b). PMID: 8660979

Cd52 (alias CDW52 CAMPATH-1 antigen precursor, Cambridge pathology 1 antigen, Epididymal secretory protein E5) encodes 6614Da protein (SEQ ID NO: 95) designated CD52 antigen (NP_001794) on chromosome 1 (Ensembl cytogenetic band: 1p36.11). Representative nucleotide sequence NM_001803 (SEQ ID NO: 96). CD52 is a human GPI-anchored antigen, expressed exclusively in the immune system and part of the reproductive system (Valentin et al. 1992; Watanabe et al. 2006). Sperm cells acquire the antigen from the epididymal secretions when transiting in the epididymal corpus and cauda. The peptide backbone of CD52, consisting of only 12 amino acids, is generally considered no more than a scaffold for post-translational modifications, such as GPI-anchor and especially N-glycosylation which occur at the third asparagine (Ermini et al. 2005). The latter modification is highly heterogeneous, especially in the reproductive system, giving rise to many different glycoforms, some of which are tissue specific. A peculiar O-glycan-containing glycoform is also found in reproductive and immune systems. See Ermini, L., Secciani, F., La Sala, G. B., Sabatini, L., Fineschi, D., Hale, G. and Rosati, F. Different glycoforms of the human GPI-anchored antigen CD52 associate differently with lipid microdomains in leukocytes and sperm membranes. Biochem. Biophys. Res. Commun. 338 (2), 1275-1283 (2005). PMID: 16266689 and Valentin, H., Gelin, C., Coulombel, L., Zoccola, D., Morizet, J. and Bernard, A. The distribution of the CDW52 molecule on blood cells and characterization of its involvement in T cell activation. Transplantation 54 (1), 97-104 (1992). PMID: 1352921 and Watanabe, T., Masuyama, J., Sohma, Y., Inazawa, H., Horie, K., Kojima, K., Uemura, Y., Aoki, Y., Kaga, S., Minota, S., Tanaka, T., Yamaguchi, Y., Kobayashi, T. and Serizawa, I. CD52 is a novel costimulatory molecule for induction of CD4+ regulatory T cells. Clin. Immunol. 120 (3), 247-259 (2006). PMID: 16797237

ORMDL3 encodes a 17495 Da protein, ORM I-like protein 3, (NP_644809) of 153 amino acids (SEQ ID NO: 97) on chromosome 17 (Ensembl cytogenetic band: 17q21.1). Representative nucleotide sequence NM_139280 (SEQ ID NO: 98). ORMDL3 belongs to a novel gene family comprising three genes in humans (ORMDL1, ORMDL2 and ORMDL3), with homologs in yeast, microsporidia, plants, Drosophila, urochordates and vertebrates. The human genes are expressed ubiquitously in adult and fetal tissues. The ORMDL genes encode transmembrane proteins anchored in the endoplasmic reticulum (ER). Subcellular localization and the response of yeast mutants to specific agents point to the involvement of ORMDL in protein folding in the ER (Hjelmqvist et al. 2002). See Hjelmqvist, L., Tuson, M., Marfany, G., Herrero, E., Balcells, S, and Gonzalez-Duarte, R. ORMDL proteins are a conserved new family of endoplasmic reticulum membrane proteins. Genome Biol. 3 (6), RESEARCH0027 (2002). PMID: 12093374

MAP3k11 (alias MLK3, PTK1, SPRK, MLK-3, MGC171) encodes mitogen-activated protein kinase 11 (MAP3K11), a 92688 Da protein (Reference protein sequence NP_002410) of 847 amino acids (SEQ ID NO: 99) on chromosome 11 (Ensembl cytogenetic band: 11q13.1). Reference nucleic acid sequence NM_002419 (SEQ ID NO: 100). MAP3k11 is a member of the serine/threonine kinase family. This kinase contains a SH3 domain and a leucine zipper-basic motif. This kinase preferentially activates MAPK8/JNK kinase, and functions as a positive regulator of JNK signaling pathway (Gallo et al. 1994). This kinase can directly phosphorylate, and activates IkappaB kinase alpha and beta, and is found to be involved in the transcription activity of NF-kappaB mediated by Rho family GTPases and CDC42. Required for serum-stimulated cell proliferation and for mitogen and cytokine activation of MAPK14 (p38), MAPK3 (ERK) and MAPK8. Plays a role in mitogen-stimulated phosphorylation and activation of BRAF, but does not phosphorylate BRAF directly (Chadee and Kyriakis 2004). Influences microtubule organization during the cell cycle (Cha et al. 2006). See Chadee, D. N. and Kyriakis, J. M. MLK3 is required for mitogen activation of B-Raf, ERK and cell proliferation. Nat. Cell Biol. 6 (8), 770-776 (2004). PMID: 15258589 and Gallo, K. A., Mark, M. R., Scadden, D. T., Wang, Z., Gu, Q. and Godowski, P. J. Identification and characterization of SPRK, a novel src-homology 3 domain-containing proline-rich kinase with serine/threonine kinase activity. J. Biol. Chem. 269 (21), 15092-15100 (1994) and Cha, H., Dangi, S., Machamer, C. E. and Shapiro, P. Inhibition of mixed-lineage kinase (MLK) activity during G2-phase disrupts microtubule formation and mitotic progression in HeLa cells. Cell. Signal. 18 (1), 93-104 (2006)

The UBXD8 gene (alias KIAA0887, ETEA) encodes UBX domain containing 8 (NP_055428), a 52623 Da protein (SEQ ID NO: 101) of 445 amino acids, on chromosome 5 (Ensembl cytogenetic band: 5q35.2). Representative nucleotide sequence NM_014613 (SEQ ID NO: 102). The protein encoded by this gene is highly expressed in peripheral blood of patients with atopic dermatitis (AD), compared to normal individuals. It may play a role in regulating the resistance to apoptosis that is observed in T cells and eosinophils of AD patients (Imai et al. 2002). See Imai, Y., Nakada, A., Hashida, R., Sugita, Y., Tanaka, T., Tsujimoto, G., Matsumoto, K., Akasawa, A., Saito, H. and Oshida, T. Cloning and characterization of the highly expressed ETEA gene from blood cells of atopic dermatitis patients. Biochem. Biophys. Res. Commun. 297 (5), 1282-1290 (2002). PMID: 12372427.

Lectin, galactoside-binding, soluble, 8 (galectin 8) (aliases LGALS8, Gal-8, PCTA1, PCTA-1, Po66-CBP) encodes a 35539 Da protein of 316 amino acids, galectin-8 (representative protein sequence NP_006490.3 (SEQ ID NO: 103)) on chromosome 1q43 (Ensembl cytogenetic band). Representative nucleotide sequence NM_006499 (SEQ ID NO: 104). Galectins are beta-galactoside-binding animal lectins with conserved carbohydrate recognition domains (Carlsson et al., 2007). The galectins have been implicated in many essential functions including development, differentiation, cell-cell adhesion, cell-matrix interaction, growth regulation, apoptosis, and RNA splicing. LGALS8 is widely expressed in cells and seems to be involved in integrin-like cell interactions (Caramo et al., 2006). Alternatively spliced transcript variants encoding different isoforms have been identified. See Carlsson, S., Oberg, C. T., Carlsson, M. C., Sundin, A., Nilsson, U. J., Smith, D., Cummings, R. D., Almkvist, J., Karlsson, A. and Leffler, H. Affinity of galectin-8 and its carbohydrate recognition domains for ligands in solution and at the cell surface. Glycobiology 17 (6), 663-676 (2007); and Carcamo, C., Pardo, E., Oyanadel, C., Bravo-Zehnder, M., Bull, P., Caceres, M., Martinez, J., Massardo, L., Jacobelli, S., Gonzalez, A. Soza, A. Galectin-8 binds specific beta1 integrins and induces polarized spreading highlighted by asymmetric lamellipodia in Jurkat T cells. Exp. Cell Res. 312 (4), 374-386 (2006).

Cardiolipin (bisphosphatidyl glycerol) is an important component of the inner mitochondrial membrane, where it constitutes about 20% of the total lipid. It is typically present in metabolically active cells of the heart and skeletal muscle. It has also been observed in certain bacterial membranes. It serves as an insulator and stabilizes the activity of protein complexes important to the electron transport chain Anticardiolipin antibodies can also be increased in numerous conditions, including malaria and tuberculosis (McNeil et al., 1990). See McNeil, H. P., Simpson, R. J., Chesterman, C. N., Krilis, S. A. Anti-phospholipid antibodies are directed against a complex antigen that includes a lipid-binding inhibitor of coagulation: beta 2-glycoprotein I (apolipoprotein H). Proc. Natl. Acad. Sci. U.S.A. 87 (11): 4120 (1990).

ORMDL1 (alias DKFZp686G141) encodes a 17371 Da protein of 153 amino acids, ORM1-like protein 1 (representative protein sequence NP_057551.1 (SEQ ID NO: 105)) on chromosome 2q32.2 (Ensembl cytogenetic band). Representative nucleotide sequence NM_016467.3 (SEQ ID NO: 106). ORMDL1 belongs to a novel gene family comprising three genes in humans (ORMDL1, ORMDL2 and ORMDL3), with homologs in yeast, microsporidia, plants, Drosophila, urochordates and vertebrates. The human genes are expressed ubiquitously in adult and fetal tissues. The ORMDL1 gene encodes a transmembrane protein anchored in the endoplasmic reticulum (ER). Subcellular localization and the response of yeast mutants to specific agents point to the involvement of ORMDL in protein folding in the ER (Hjelmqvist et al., 2002). See Hjelmqvist, L., Tuson, M., Marfany, G., Herrero, E., Balcells, S, and Gonzalez-Duarte, R. ORMDL proteins are a conserved new family of endoplasmic reticulum membrane proteins. Genome Biol. 3 (6), RESEARCH0027 (2002). PMID: 12093374

TARP (alias CD3G, TCRG, TCRGC1, TCRGC2) encodes a 12847 Da protein of 111 amino acids, TARP protein (representative protein sequence NP_001003799 (SEQ ID NO: 107)) on chromosome 7p15-p14 (Entrez Gene cytogenetic band). Representative nucleotide sequence NM_001003799.1 (SEQ ID NO: 108). In some non-lymphoid tissues, the un-rearranged T cell receptor gamma (TRGγ) locus is expressed. The resulting transcript contains a subset of the TRGγ gene segments and is shorter than TRGγ transcripts expressed in lymphoid tissues (Pelicci et al. 1987; Krangel et al. 1987). The upstream ORF uses a different reading frame and encodes the novel protein TARP. The resulting protein localizes to the outer mitochondrial membrane and appears to be selectively expressed in the prostate (Maeda et al. 2004). See Maeda, H., Nagata, S., Wolfgang, C. D., Bratthauer, G. L., Bera, T. K. and Pastan, I. The T cell receptor gamma chain alternate reading frame protein (TARP), a prostate-specific protein localized in mitochondria. J. Biol. Chem. 279 (23), 24561-24568 (2004); Pelicci, P. G., Subar, M., Weiss, A., Dalla-Favera, R. and Littman, D. R. Molecular diversity of the human T-gamma constant region genes. Science 237 (4818), 1051-1055 (1987); and Krangel, M. S., Band, H., Hata, S., McLean, J. and Brenner, M. B. Structurally divergent human T cell receptor gamma proteins encoded by distinct C gamma genes. Science 237 (4810), 64-67 (1987).

SERINC2 (alias TDE2, TDE2L, FKSG84, PRO0899, MGC90340) encodes a 50781 Da protein of 456 amino acids, serine incorporator 2 (representative protein sequence NP_849196.2 (SEQ ID NO: 109)) encoded on chromosome 1p35.2 (Ensembl cytogenetic band). Representaive nucleotide sequence NM_178865 (SEQ ID NO: 110). SERINC2 belongs to a family of eukaryotic membrane proteins which incorporate serine into membranes and facilitate the synthesis of the serine-derived lipids phosphatidylserine and sphingolipid (Player et al. 2003; Inuzuka et al. 2005). See Player, A., Gillespie, J., Fujii, T., Fukuoka, J., Dracheva, T., Meerzaman, D., Hong, K. M., Curran, J., Attoh, G., Travis, W. and Jen, J. Identification of TDE2 gene and its expression in non-small cell lung cancer. Int. J. Cancer 107 (2), 238-243 (2003); and Inuzuka, M., Hayakawa, M., Ingi, T. SERINC, an activity-regulated protein family, incorporates serine into membrane lipid synthesis. J Biol Chem. (2005) Oct. 21; 280 (42):35776-83.

SSR3 (alias TRAPG, SSR gamma) encodes a 21080 Da protein, Translocon-associated protein subunit gamma (representative protein sequence NP_009038.1 (SEQ ID NO: 111)) of 185 amino acids on chromosome 3q25.31 (Ensembl cytogenetic band). Representative nucleotide sequence NM_007107 (SEQ ID NO: 112). The signal sequence receptor (SSR) is a glycosylated endoplasmic reticulum (ER) membrane receptor associated with protein translocation across the ER membrane (Wang et al. 1999). The SSR is comprised of four membrane proteins/subunits: alpha, beta, gamma, and delta (Hartmann et al. 1993). The first two are glycosylated subunits and the latter two are non-glycosylated subunits. The protein encoded by this gene is the gamma subunit and is predicted to span the membrane four times. See Wang, L. and Dobberstein, B. Oligomeric complexes involved in translocation of proteins across the membrane of the endoplasmic reticulum. FEBS Lett. 457 (3), 316-322 (1999); and Hartmann, E., Gorlich, D., Kostka, S., Otto, A., Kraft, R., Knespel, S., Burger, E., Rapoport, T. A. and Prehn, S. A tetrameric complex of membrane proteins in the endoplasmic reticulum. Eur. J. Biochem. 214 (2), 375-381 (1993).

RPS6KA2 (alias RSK, HU-2, RSK3, p90-RSK3, pp 90RSK3, MAPKAPK1C, S6K-alpha, S6K-alpha2) is a 83239 Da protein, Ribosomal protein S6 kinase alpha-2 (representative protein sequence NP_066958.2 (SEQ ID NO: 113)) of 731 amino acids on chromosome 6q27 (Ensembl cytogenetic band). Representative nucleotide sequence NM_021135 (SEQ ID NO: 114). This gene encodes a member of the RSK (ribosomal S6 kinase) family of serine/threonine kinases. This kinase contains 2 non-identical kinase catalytic domains and phosphorylates various substrates, including members of the mitogen-activated kinase (MAPK) signalling pathway (Xing et al. 1996). The activity of this protein has been implicated in controlling cell growth and differentiation (Wong et al. 1996; Zhao et al. 1995). Alternate transcriptional splice variants, encoding different isoforms, have been characterized. See Xing, J., Ginty, D. D. and Greenberg, M. E. Coupling of the RAS-MAPK pathway to gene activation by RSK2, a growth factor-regulated CREB kinase. Science 273 (5277), 959-963 (1996); Wong, E. V., Schaefer, A. W., Landreth, G. and Lemmon, V. Involvement of p90rsk in neurite outgrowth mediated by the cell adhesion molecule L1. J. Biol. Chem. 271 (30), 18217-18223 (1996); and Zhao, Y., Bjorbaek, C., Weremowicz, S., Morton, C. C. and Moller, D. E. RSK3 encodes a novel pp 90rsk isoform with a unique N-terminal sequence: growth factor-stimulated kinase function and nuclear translocation. Mol. Cell. Biol. 15 (8), 4353-4363 (1995).

LGALS3 (alias GAL3, MAC2, CBP35, GALBP, GALIG, LGALS2) encodes a 26188 amino acid protein, Galectin-3 (representative protein sequence NP_002297 (SEQ ID NO: 115)) of 250 amino acids on chromosome: 14q22.3 (Ensembl cytogenetic band). Representative nucleotide sequence NM_002306 (SEQ ID NO: 116). Galectins are a family of β-galactoside-binding proteins highly conserved throughout animal evolution, which are present at different subcellular compartments (Raz et al. 1991). These proteins modulate several biological processes, such as cell adhesion, migration, proliferation, and apoptosis. Recent evidence indicates that galectins can interact with ECM glycoproteins and modulate cell-cell interactions within the thymic microenvironment (Mini-Osorio et al. 2007; Yu et al. 2007). See Mina-Osorio, P., Soto-Cruz, I. and Ortega, E. A role for galectin-3 in CD13-mediated homotypic aggregation of monocytes Biochem. Biophys. Res. Commun. 353 (3), 605-610 (2007); Yu, L. G., Andrews, N., Zhao, Q., McKean, D., Williams, J. F., Connor, L. J., Gerasimenko, O. V., Hilkens, J., Hirabayashi, J., Kasai, K. and Rhodes, J. M. Galectin-3 interaction with Thomsen-Friedenreich disaccharide on cancer-associated MUC1 causes increased cancer cell endothelial adhesion. J. Biol. Chem. 282 (1), 773-781 (2007); and Raz, A., Carmi, P., Raz, T., Hogan, V., Mohamed, A. and Wolman, S. R. Molecular cloning and chromosomal mapping of a human galactoside-binding protein. Cancer Res. 51 (8), 2173-2178 (1991).

SELS (Alias: VIMP, ADO15, SBBI8, SEPS1, AD-015, MGC2553, MGC104346) is a 21116 Da protein, Selenoprotein S (representative amino acid sequence NP_982298.1; SEQ ID NO: 117) of 189 amino acids on chromosome 15q26.3 (Ensembl cytogenetic band). Representative nucleotide sequence NM_203472 (SEQ ID NO: 118). SELS is involved in the degradation process of misfolded endoplasmic reticulum (ER) luminal proteins, participating in the transfer of misfolded proteins from the ER to the cytosol, where they are destroyed by the proteasome in a ubiquitin-dependent manner (Ye et al. 2005). SELS may act by serving as a linker between DERL1, which mediates the retrotranslocation of misfolded proteins into the cytosol, and the ATPase complex VCP, which mediates the translocation and ubiquitination and suggesting that it forms a membrane complex with DERL1 that serves as a receptor for VCP (Lilley et al. 2005). See Ye, Y., Shibata, Y., Kikkert, M., van Voorden, S., Wiertz, E. And Rapoport, T. A. Inaugural Article: Recruitment of the p97 ATPase and ubiquitin ligases to the site of retrotranslocation at the endoplasmic reticulum membrane. Proc. Natl. Acad. Sci. U.S.A. 102 (40), 14132-14138 (2005); and Lilley, B. N. and Ploegh, H. L. Multiprotein complexes that link dislocation, ubiquitination, and extraction of misfolded proteins from the endoplasmic reticulum membrane. Proc. Natl. Acad. Sci. U.S.A. 102 (40), 14296-14301 (2005).

C14orf147 (alias MGC24447, LOC171546) encodes a 8207 Da protein, UPF0445 protein C14orf147 (representative protein sequence NP_612145.2 (SEQ ID NO: 119)) of 68 amino acids on chromosome 14q13.1 (Ensembl cytogenetic band). Representative nucleotide sequence NM_138288 (SEQ ID NO: 120). C14orf147 belongs to the UPF0445 family of proteins. Seqeunce analysis indicates possible membrane localization as a multi-pass membrane protein. See Strausberg, R. L. et al., Mammalian Gene Collection Program Team. Generation and initial analysis of more than 15,000 full-length human and mouse cDNA sequences. Proc Natl Acad Sci USA. 2002 Dec. 24; 99(26): 16899-903.

Similar to CG10671-like (alias MGC46490) encodes two proteins, one of 32207 Da (representative protein sequence A5D6W6—UniProt/TrEMBL (SEQ ID NO: 121)) and 292 amino acids; and another of 10778 Da (representative protein sequence Q8IUQ7—UniProt/TrEMBL (SEQ ID NO: 122)) and 96 amino acids on chromosome 14q11.2 (Ensembl cytogenetic band). Representative nucleotide sequence NM_203402.1 (SEQ ID NO: 123). See Strausberg, R. L. et al. Mammalian Gene Collection Program Team. Generation and initial analysis of more than 15,000 full-length human and mouse cDNA sequences. Proc Natl Acad Sci USA. 2002 Dec. 24; 99(26): 16899-903.

CAV3 (alias VIP21, LGMD1C, VIP-21, MGC126100, MGC126101, MGC126129) encodes a 17259 Da protein, caveolin 3 (representative protein sequence NP_001225.1 (SEQ ID NO: 124)) of 151 amino acids encoded on chromosome 3p25.3 (Ensembl cytogenetic band). Representative nucleotide sequence NM_001234 (SEQ ID NO: 125). CAV3 encodes a caveolin family member, which functions as a component of the caveolae plasma membranes found in most cell types. Caveolin proteins are proposed to be scaffolding proteins for organizing and concentrating certain caveolin-interacting molecules (Scherer and Listanti 1997; Li et al. 1995). Mutations identified in this gene lead to interference with protein oligomerization or intra-cellular routing, disrupting caveolae formation and resulting in Limb-Girdle muscular dystrophy type-1C (LGMD-1C), hyperCKemia or rippling muscle disease (RMD). Alternative splicing has been identified for this locus, with inclusion or exclusion of a differentially spliced intron. In addition, transcripts utilize multiple polyA sites and contain two potential translation initiation sites (Tang et al. 1996). See Scherer, P. E. and Lisanti, M. P. Association of phosphofructokinase-M with caveolin-3 in differentiated skeletal myotubes. Dynamic regulation by extracellular glucose and intracellular metabolites. J. Biol. Chem. 272 (33), 20698-20705 (1997); Tang, Z., Scherer, P. E., Okamoto, T., Song, K., Chu, C., Kohtz, D. S., Nishimoto, I., Lodish, H. F. and Lisanti, M. P. Molecular cloning of caveolin-3, a novel member of the caveolin gene family expressed predominantly in muscle. J. Biol. Chem. 271 (4), 2255-2261 (1996); and Li, S., Okamoto, T., Chun, M., Sargiacomo, M., Casanova, J. E., Hansen, S. H., Nishimoto, I. and Lisanti, M. P. Evidence for a regulated interaction between heterotrimeric G proteins and caveolin. J. Biol. Chem. 270 (26), 15693-15701 (1995).

CYB561D2 (alias 101F6, TSP10) encodes a 23974 Da protein, cytochrome b-561 domain containing 2 (representative amino acid sequence NP_008953.1; SEQ ID NO: 126) of 222 amino acids on chromosome 3p21.31 (Ensembl cytogenetic band). Representative nucleotide sequence NM_007022 (SEQ ID NO: 127). Binds 2 heme groups non-covalently (by similarity). Sequence analysis indicates possible membrane localization as a multi-pass membrane protein (Townsley et al. 1997; Lerman and Minna 2000). See Lerman, M. I. and Minna, J. D. The 630-kb lung cancer homozygous deletion region on human chromosome 3p21.3: identification and evaluation of the resident candidate tumor suppressor genes. The International Lung Cancer Chromosome 3p21.3 Tumor Suppressor Gene Consortium. Cancer Res. 60 (21), 6116-6133 (2000); and Townsley, F. M., Aristarkhov, A., Beck, S., Hershko, A. and Ruderman, J. V. Dominant-negative cyclin-selective ubiquitin carrier protein E2-C/UbCH10 blocks cells in metaphase. Proc. Natl. Acad. Sci. U.S.A. 94 (6), 2362-2367 (1997).

ORMDL2 (alias MST095, HSPC160, MSTP095, adoplin-2) encodes a 17363 Da protein of 153 amino acids, ORM-1 like 2 (representative amino acid sequence NP_054901.1 (SEQ ID NO: 128)) on chromosome 12q13.2 (Ensembl cytogenetic band). Representative nucleotide sequence NM_014182 (SEQ ID NO: 129). ORMDL2 belongs to a novel gene family comprising three genes in humans (ORMDL1, ORMDL2 and ORMDL3), with homologs in yeast, microsporidia, plants, Drosophila, urochordates and vertebrates. The human genes are expressed ubiquitously in adult and fetal tissues. The ORMDL2 gene encodes a transmembrane protein anchored in the endoplasmic reticulum (ER). Subcellular localization and the response of yeast mutants to specific agents point to the involvement of ORMDL in protein folding in the ER (Hjelmqvist et al. 2002). See Hjelmqvist, L., Tuson, M., Marfany, G., Herrero, E., Balcells, S, and Gonzalez-Duarte, R. ORMDL proteins are a conserved new family of endoplasmic reticulum membrane proteins. Genome Biol. 3 (6), RESEARCH0027 (2002).

SPCS1 (alias SPC1, SPC12, HSPCO33, YJR010C-A) encodes a 11805 Da protein, signal peptidase complex subunit 1 homolog (Representative amino acid sequence NP_054760.2; (SEQ ID NO: 130)) of 102 amino acids on chromosome 3p21.1 (Ensembl cytogenetic band). Representative nucleotide sequence NM_014041; (SEQ ID NO: 131). SPCS1, by similarity, appears to be a component of the microsomal signal peptidase complex which removes signal peptides from nascent proteins as they are translocated into the lumen of the endoplasmic reticulum. The microsomal signal peptidase complex consists of five members: SEC11A, SEC11C, SPCS1, SPCS2 and SPCS3. By similarity it appears to be a multi-pass membrane protein of the microsome membrane (Kalies and Hartmann 1996). See Kalies, K. U. and Hartmann, E. Membrane topology of the 12- and the 25-kDa subunits of the mammalian signal peptidase complex. J. Biol. Chem. 271 (7), 3925-3929 (1996).

C21orf51 is a 6886 Da protein, uncharacterized protein C21orf51 (representative amino acid sequence NP_478062.1; (SEQ ID NO: 132) of 58 amino acids on chromosome 21q22.11 (Ensembl cytogenetic band). Representative nucleotide sequence NM_058182 (SEQ ID NO: 133). Expressed in heart, spleen, liver, stomach, muscle, lung, testis, skin, PBL and bone marrow (Adams et al. 1995; Reymond et al. 2001; Gardiner et al. 2002). See Gardiner, K., Slavov, D., Bechtel, L. and Davisson, M. Annotation of human chromosome 21 for relevance to Down syndrome: gene structure and expression analysis. Genomics 79 (6), 833-843 (2002); Reymond, A., Friedli, M., Henrichsen, C. N., Chapot, F., Deutsch, S., Ucla, C., Rossier, C., Lyle, R., Guipponi, M. and Antonarakis, S. E. From PREDs and open reading frames to cDNA isolation: revisiting the human chromosome 21 transcription map. Genomics 78 (1-2), 46-54 (2001); and Adams, M. D., Kerlavage, A. R., Fleischmann, R. D., Fuldner, R. A., Bult, C. J., Lee, N. H., Kirkness, E. F., Weinstock, K. G., Gocayne, J. D., White, O. et al. Initial assessment of human gene diversity and expression patterns based upon 83 million nucleotides of cDNA sequence. Nature 377 (6547 SUPPL), 3-174 (1995).

KLHDC7B (alias MGC16635) encodes a 53295 Da protein, kelch domain containing 7B (representative amino acid sequence NP_612442.1 (SEQ ID NO: 134)) of 495 amino acids encoded on chromosome 22q13.33 (Ensembl cytogenetic band). Representative nucleotide sequence NM_138433 (SEQ ID NO: 135).

NRP1 (aliases NRP, CD304, VEGF165R, DKFZp781F1414, DKFZp686A03134) encodes the 103120 Da, 923 amino acid protein neuropilin-1 (representative amino acid sequence NP_001019799; SEQ ID NO: 136) encoded on chromosome 10p11.22 (Ensembl cytogenetic band). Representative nucleotide sequence NM_001024628 (SEQ ID NO: 137). NRP1 is a membrane-bound coreceptor to a tyrosine kinase receptor for both vascular endothelial growth factor (VEGF; MIM 192240) and semaphorin (see SEMA3A; MIM 603961) family members (Chen et al. 1998). NRP1 plays versatile roles in angiogenesis, axon guidance, cell survival, migration, and invasion (Pan et al. 2007; Soker et al. 1998). See Pan, Q., Chathery, Y., Wu, Y., Rathore, N., Tong, R. K., Peale, F., Bagri, A., Tessier-Lavigne, M., Koch, A. W. and Watts, R. J, Neuropilin-1 binds to VEGF121 and regulates endothelial cell migration and sprouting, J. Biol. Chem. 282 (33), 24049-24056 (2007); Chen, H., He, Z., Bagri, A. and Tessier-Lavigne, M., Semaphorin-neuropilin interactions underlying sympathetic axon responses to class III semaphorins, Neuron 21 (6), 1283-1290 (1998); and Soker, S., Takashima, S., Miao, H. Q., Neufeld, G. and Klagsbrun, M, Neuropilin-1 is expressed by endothelial and tumor cells as an isoform-specific receptor for vascular endothelial growth factor, Cell 92 (6), 735-745 (1998).

Nrp2 (aliases NP2, NPN2, PRO2714, MGC126574, VEGF165R2) encodes the 104831 Da, 931 amino acid protein neuropilin-2 (representative amino acid sequence NP_003863; SEQ ID NO: 138) encoded on chromosome 2q33.3 (Ensembl cytogenetic band). Representative nucleotide sequence NM_003872.2 (SEQ ID NO: 139). This gene encodes a member of the neuropilin family of receptor proteins (Chen et al. 1997). The encoded transmembrane protein binds to SEMA3C protein {sema domain, immunoglobulin domain (Ig), short basic domain, secreted, (semaphorin) 3C} and SEMA3F protein {sema domain, immunoglobulin domain (Ig), short basic domain, secreted, (semaphorin) 3F}, and interacts with vascular endothelial growth factor (VEGF). This protein may play a role in cardiovascular development and axon guidance (Giger et al. 1998; Takahashi et al. 1998; Chen et al. 1998). Multiple transcript variants encoding distinct isoforms have been identified for this gene. See Chen, H., He, Z., Bagri, A. and Tessier-Lavigne, M, Semaphorin-neuropilin interactions underlying sympathetic axon responses to class III semaphorins, Neuron 21 (6), 1283-1290 (1998); Giger, R. J., Urquhart, E. R., Gillespie, S. K., Levengood, D. V., Ginty, D. D. and Kolodkin, A. L., Neuropilin-2 is a receptor for semaphorin IV: insight into the structural basis of receptor function and specificity, Neuron 21 (5), 1079-1092 (1998); Takahashi, T., Nakamura, F., Jin, Z., Kalb, R. G.

and Strittmatter, S. M, Semaphorins A and E act as antagonists of neuropilin-1 and agonists of neuropilin-2 receptors, Nat. Neurosci. 1 (6), 487-493 (1998); and Chen, H., Chedotal, A., He, Z., Goodman, C. S, and Tessier-Lavigne, M, Neuropilin-2, a novel member of the neuropilin family, is a high affinity receptor for the semaphorins Sema E and Sema IV but not Sema III, Neuron 19 (3), 547-559 (1997).

C11orf24 (alias DM4E3, UNQ1872/PRO4315) encodes the 46101 Da, 449 amino acids protein hypothetical protein LOC53838 (representative protein sequence NP_071733.1; SEQ ID NO: 140) on chromosome 11q13.2 (Ensembl cytogenetic band). Representative nucleotide sequence NM_022338 (SEQ ID NO: 141). By sequencing the IDDM4 region of chromosome 11, followed by database analysis, Twells et al. (2001) cloned C11ORF24. Northern blot analysis detected high expression of a 1.9-kb transcript in heart, placenta, liver, pancreas, and colon. Lower levels were detected in brain, lung, skeletal muscle, kidney, spleen, prostate, testis, ovary, and small intestine, and very low levels were detected in thymus and leukocytes. LOC53838 appears to be a type-1 membrane protein (predicted). See Twells, R. C. J.; Metzker, M. L.; Brown, S. D.; Cox, R.; Garey, C.; Hammond, H.; Hey, P. J.; Levy, E.; Nakagawa, Y.; Philips, M. S.; Todd, J. A.; Hess, J. F, The sequence and gene characterization of a 400-kb candidate region for IDDM4 on chromosome 11q13, Genomics 72: 231-242, 2001.

COMMD2 (alias HSPC042, MGC57611) encodes the 22745 Da, 199 amino acid protein COMM domain containing 2 (representative protein sequence NP_057178.2; SEQ ID NO: 142) on chromosome 3q25.1 (Ensembl cytogenetic band). Representative nucleotide sequence NM_016094 (SEQ ID NO: 143). COMMD2 belongs to the COMM family of proteins which is defined by the presence of a conserved and unique motif termed the COMM (copper metabolism gene NURR1) domain, which functions as an interface for protein-protein interactions (Burstein et al. 2005). The homologous MURR1 protein is a multifunctional protein that inhibits nuclear factor kappaB (NF-kappaB), a transcription factor with pleiotropic functions affecting innate and adaptive immunity, apoptosis, cell cycle regulation, and oncogenesis. See Burstein, E., Hoberg, J. E., Wilkinson, A. S., Rumble, J. M., Csomos, R. A., Komarck, C. M., Maine, G. N., Wilkinson, J. C., Mayo, M. W., Duckett, C. S., COMMD proteins, a novel family of structural and functional homologs of MURR1, J. Biol. Chem. 280 (23), 22222-22232 (2005).

DLD (alias E3, LAD, DLDH, GCSL, PHE3) encodes 54150 Da, 509 amino acid protein dihydrolipoamide dehydrogenase (representative protein sequence NP_000099.2; SEQ ID NO: 144) on chromosome 7q31.1 (Ensembl cytogenetic band). Representative nucleotide sequence NM_000108 (SEQ ID NO: 145). This gene encodes the L protein of the mitochondrial glycine cleavage system. The L protein, also named dihydrolipoamide dehydrogenase, is also a component of the pyruvate dehydrogenase complex, the alpha-ketoglutarate dehydrogenase complex, and the branched-chain alpha-keto acid dehydrogenase complex (Pons et al. 1988; Kume et al. 1991; Ciszak et al. 2006). Mutations in this gene have been identified in patients with E3-deficient maple syrup urine disease and lipoamide dehydrogenase deficiency. See Pons, G., Raefsky-Estrin, C., Carothers, D. J., Pepin, R. A., Javed, A. A., Jesse, B. W., Ganaphthi, M. K., Samols, D., Patel, M. S, Cloning and cDNA sequence of the dihydrolipoamide dehydrogenase component human alpha-ketoacid dehydrogenase complexes, Proc. Natl. Acad. Sci. U.S.A. 85 (5), 1422-1426 (1988); Kume, A., Koyata, H., Sakakibara, T., Ishiguro, Y., Kure, S., Hiraga, K, The glycine cleavage system. Molecular cloning of the chicken and human glycine decarboxylase cDNAs and some characteristics involved in the deduced protein structures, J. Biol. Chem. 266 (5), 3323-3329 (1991); and Ciszak, E. M., Makal, A., Hong, Y. S., Vettaikkorumakankauv, A. K., Korotchkina, L. G. and Patel, M. S., How dihydrolipoamide dehydrogenase-binding protein binds dihydrolipoamide dehydrogenase in the human pyruvate dehydrogenase complex, J. Biol. Chem. 281 (1), 648-655 (2006).

OTUD4 (alias HIN1, DUBA6, HSHIN1, KIAA1046, DKFZp4341072) encodes a 124045 Da, 1114 amino acids protein OTU domain containing 4 protein (representative amino acid sequence NP_955356; SEQ ID NO: 146) on chromosome 4q31.21 (Ensembl cytogenetic band). Representative nucleotide sequence NM_199324 (SEQ ID NO: 147). OTU domain containing 4 protein is a putative odorant receptor that localizes to the cell membrane as a G-protein coupled receptor 1 family member.

ZCCHC9 (alias DKFZp761J139) encodes a 30477 Da, 271 amino acids protein zinc finger, CCHC domain containing 9 (representative amino acid sequence NP_115656.1; SEQ ID NO: 148) on chromosome 5q14.1 (Ensembl cytogenetic band). Representative nucleotide sequence NM_032280 (SEQ ID NO: 149). The function and interaction partners of protein zinc finger, CCHC domain containing 9 is currently unknown.

LOC283871 (alias MGC4692) encodes a 33875 Da, 321 amino acid protein hypothetical protein LOC283871 (representative amino acid sequence NP_001035830; SEQ ID NO: 150) on chromosome 16p13.3 (Ensembl cytogenetic band). Representative nucleotide sequence NM_001042371 (SEQ ID NO: 151). The function and interaction partners of protein hypothetical protein LOC283871 is currently unknown.

6.3 Methods of Using Antigens

In accordance with the present invention, the antigens of the invention find use in a variety of methods, including methods for determining whether an immune response against cancer cells has been induced in a subject, methods for determining whether an immune response effective to treat, prevent, or ameliorate a symptom of prostate cancer in a subject has been induced in the subject, methods for determining whether a subject afflicted with prostate cancer is likely to respond to treatment with genetically modified tumor cells that produce GM-CSF, and methods for assessing the effectiveness of prostate cancer therapy with genetically modified tumor cells that express GM-CSF to treat or ameliorate a symptom of prostate cancer of a subject in need thereof.

In certain embodiments, the cancer cells are prostate cancer cells.

In another aspect, the invention provides a method for determining whether an immune response effective to treat, prevent, or ameliorate a symptom of prostate cancer in a subject has been induced in the subject, comprising detecting an immune response against an antigen listed in Table 1, 2, 3, 4, 5, or 6, detecting said antigen indicates that an immune response effective to treat, prevent, or ameliorate a symptom of prostate cancer has been induced in the subject. In certain embodiments, an immune response against 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 75, 80, 85, 90, 95, 100, 105, 110, or more of the antigens is detected.

In certain embodiments, the immune response that has been induced is effective to prevent prostate cancer in the subject. In certain embodiments, the immune response that has been induced is effective to treat prostate cancer in the subject. In certain embodiments, the immune response that has been induced is effective to ameliorate a symptom of prostate cancer in the subject. In certain embodiments, the symptom of prostate cancer that is ameliorated is selected from the group consisting of a reduction in the level of prostate specific antigen (PSA) level in the subject's serum, cancer-associated pain, and metastasis. In certain embodiments, the immune response is effective to result in decreased serum concentrations of tumor specific markers, increased overall survival time, increased progression-free survival, decreased tumor size, decreased bone metastasis marker response, increased impact on minimal residual disease, increased induction of antibody response to the cancer cells that have been rendered proliferation-incompetent, increased induction of delayed-type-hypersensitivity (DTH) response to injections of autologous tumor, increased induction of T cell response to autologous tumor or candidate tumor-associated antigens, or increased impact on circulating T cell and dendritic cell numbers, phenotype, and function, cytokine response Any method known by skilled in the art for detecting an immune response can be used in accordance with the present invention. In certain embodiments, the immune response is detected by western blot. In certain embodiments, the immune response is detected by ELISA. In certain embodiments, the immune response is detected by protein array analysis.

6.4 Correlation of Immune Response with Likelihood of Responding or Responsiveness Clinical datasets of immune responses with clinical outcome data can be used to correlate immune Reponses with likelihood of responding to cancer therapy or with responsiveness to cancer therapy.

Any method known in the art, without limitation, can be used to assess the immune response of a subject administered a cancer therapy, e.g., a cell-based cancer immunotherapy such as, e.g., GVAX® therapy. For example, such immune responses can be assessed by western blot, by ELISA, by protein array analysis, and the like.

Similarly, any method known in the art can be used to determine whether an immune response is correlated with responsiveness to cancer therapy. Typically, P values are used to determine the statistical significance of the correlation, such that the smaller the P value, the more significant the measurement. Preferably the P values will be less than 0.05 (or 5%). More preferably, P values will be less than 0.01. P values can be calculated by any means known to one of skill in the art. For the purposes of correlating an immune response with responsiveness to cancer therapy, P values can be calculated using Fisher's Exact Test. See, e.g., David Freedman, Robert Pisani & Roger Purves, 1980, STATISTICS, W. W. Norton, New York. P values may be calculated using Student's paired and/or unpaired t-test and the non-parametric Kruskal-Wallis test (Statview 5.0 software, SAS, Cary, N.C.).

Typically, immune responses are measured from biological samples obtained from a subject. Biological samples from a subject include, for example and without limitation, blood, blood plasma, serum, urine, saliva, tissue swab and the like.

6.5 Constructing an Algorithm

In one aspect, the present invention provides a method of constructing an algorithm that correlates immune response data with responsiveness to cancer therapy, e.g., a cell-based cancer immunotherapy such as, e.g., GVAX® therapy. In one embodiment, the method of constructing the algorithm comprises creating a rule or rules that correlate immune response data with responsiveness to cancer therapy, e.g., a cell-based cancer immunotherapy such as, e.g., GVAX® therapy.

In one embodiment, a data set comprising immune response data and clinical outcome data about each subject in a set of subjects is assembled. Any method known in the art can be used to collect immune response data. Examples of methods of collecting such data are provided above. Any method known in the art can be used for collecting clinical outcome data.

In some embodiments, the data set comprises immune responses against one or more antigens as described herein. In some embodiments, the data set comprises immune responses against 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 75, 80, 85, 90, 95, 100, 105, 110, or more antigens.

In some embodiments, the clinical outcome data comprises information regarding the level of prostate specific antigen (PSA) level in the subject's serum, cancer-associated pain, and/or metastasis. In certain embodiments, In some embodiments, the clinical outcome data comprises information regarding the serum concentrations of tumor specific markers, e.g., PSA, overall survival time, progression-free survival, tumor size, bone metastasis marker response, impact on minimal residual disease, induction of antibody response to the cancer cells that have been rendered proliferation-incompetent, induction of delayed-type-hypersensitivity (DTH) response to injections of autologous tumor, induction of T cell response to autologous tumor or candidate tumor-associated antigens, and/or impact on circulating T cell and dendritic cell numbers, phenotype, and function, cytokine response The immune response and clinical outcome data in the data set can be represented or organized in any way known in the art. In one embodiment, the data are displayed in the form of a graph. In another embodiment, the immune response and clinical outcome data in the data set are displayed in the form of a chart.

In one aspect, an algorithm is formulated that correlates the immune response with the clinical outcome data in the data set. In one embodiment, a clinical outcome cutoff point is defined. In some embodiments, the clinical outcome cutoff point is determined relative to a reference subject, and the cutoff point is the is the value above or below which a subject is defined as responsive to the cancer therapy and below or above which a virus or population of viruses is defined nonresponsive to the cancer therapy. One skilled in the art will recognize that for some clinical indicators, e.g., survival time, an increase in the clinical indicator indicates responsiveness, while for other clinical indicators, e.g., tumor size or tumor marker, an increase in the clinical indicator indicates nonresponsiveness.

In another embodiment, the upper or lower clinical cutoff point is used to define the level of immune responsiveness. In one embodiment, the number of antigens against which an immune response and/or the concentration of antibodies against an antigen against which an immune response is raised is correlated with the clinical outcome data. A immune response cutoff point can be selected such that most subjects having an immune response against more than that number of antigens or with a concentration of antibodies higher than the cutoff concentration in the data set are immunologically responsive to treatment (IR-R), and most subjects having fewer or less than that number are immunologically not responsive (IR-N). By definition, a subject in the data set with clinical outcome data more or less than, as appropriate, the clinical outcome cutoff is clinically responsive ("CL-R") to the cancer treatment, and a subject in the data set with fewer or more than, as appropriate, the clinical outcome cutoff is clinically nonresponsive ("CL-N") to the treatment. Thus, in one embodiment, a immune response cutoff point is selected that produces the greatest percentage of subject in the data set that are either clinically and immunologically responsive ("IR-R, CL-R"), or immunologically responsive and clinically nonresponsive ("IR-N, CL-N").

While this simple algorithm can provide a useful approximation of the relationship between the immune response and clinical outcome data in the data set, in most cases there will be a significant number of subjects that are clinically nonresponsive but immunologically responsive ("CL-N, IR-R"), or immunologically nonresponsive but clinically responsive ("CL-R, IR-N"). These discordant results are a measure of the inaccuracy of the algorithm. Thus, in some embodiments, the algorithm is further modified to reduce the percentage of discordant results in the data set.

In another embodiment, the percentage of discordant results is reduced by assigning differential weight values to immune responses against one or more antigens observed in the data set. An algorithm that does not include this step assumes that each immune response in the data set contributes equally to the overall clinical outcome. In many cases this will not be true. For example, there may be a antigen in a data set that is almost always correlated with responsiveness to a cancer treatment. That is, almost every subject that has an immune response against the antigen is clinically responsive, even those subjects having an immune response against only one or two total antigens. In one embodiment, immune responses against such antigens are "weighted," e.g., assigned an increased score. An immune response can be assigned a weight of, for example, two, three, four, five, six, seven, eight or more. For example, an immune response assigned a weight of 2 can be counted as two immune responses in a subject. Fractional weighting values can also be assigned. In certain embodiments, a value between zero and one can be assigned when an immune response is weakly associated with a clinical outcome. In another embodiment, values of less than zero can be assigned, wherein an immune response is associated with an negative clinical outcome to the anti-viral treatment.

One of skill in the art will appreciate that there is a tradeoff involved in assigning an increased weight to certain immune responses. As the weight of the immune response is increased, the number of IR-R, CL-N discordant results may increase. Thus, assigning a weight to an immune response that is too great may increase the overall discordance of the algorithm. Accordingly, in one embodiment, a weight is assigned to an immune response that balances the reduction in IR-N, CL-R results with the increase in IR-R, CL-N results.

In another embodiment, the interaction of different immune responses in the data set with each other is also factored into the algorithm. For example, it might be found that two or more immune responses behave synergistically, i.e., that the coincidence of the immune responses in a subject contributes more significantly to the clinical outcome than would be predicted based on the effect of each immune response independent of the other. Alternatively, it might be found that the coincidence of two or more immune responses in a subject contributes less significantly to the clinical outcome than would be expected from the contributions made to resistance by each immune response when it occurs independently. Also, two or more immune responses may be found to occur more frequently together than as independent immune responses. Thus, in one embodiment, immune responses occurring together are weighted together. For example, only one of the immune responses is assigned a weight of 1 or greater, and the other immune response or immune responses are assigned a weight of zero, in order to avoid an increase in the number of IR-R, CL-N discordant results.

In another aspect, the immune response cutoff point can be used to define a clinical outcome cutoff point by correlating the concentrations of antibody induced as well as the antigens against which immune responses are induced in the data set with the clinical outcome.

In one embodiment, an algorithm is constructed that factors in the requirement for a certain concentration of antibody that is induced By using, for example, the methods discussed above, the algorithm can be designed to achieve any desired result. In one embodiment, the algorithm is designed to maximize the overall concordance (the sum of the percentages of the IR-R, CL-R and the IR-N, CL-N groups, or 100−(percentage of the IR-N, CL-R+IR-R, CL-N groups). In some embodiments, the overall concordance is greater than 75%, 80%, 85%, 90% or 95%. In one embodiment, the algorithm is designed to minimize the percentage of IR-R, CL-N results. In another embodiment, the algorithm is designed to minimize the percentage of IR-N, CL-R results. In another embodiment, the algorithm is designed to maximize the percentage of IR-R, CL-R results. In another embodiment, the algorithm is designed to maximize the percentage of IR-N, CL-N results.

At any point during the construction of the algorithm, or after it is constructed, it can be further tested on a second data set. In one embodiment, the second data set consists of subjects that are not included in the data set, i.e., the second data set is a naïve data set. In another embodiment, the second data set contains one or more subjects that were in the data set and one or more subjects that were not in the data set. Use of the algorithm on a second data set, particularly a naïve data set, allows the predictive capability of the algorithm to be assessed. Thus, in one embodiment, the accuracy of an algorithm is assessed using a second data set, and the rules of the algorithm are modified as described above to improve its accuracy. In another embodiment, an iterative approach is used to create the algorithm, whereby an algorithm is tested and then modified repeatedly until a desired level of accuracy is achieved.

6.6 Using an Algorithm to Predict the Responsiveness of a Subject

In another aspect, the present invention also provides a method for using an algorithm of the invention to predict the responsiveness of a subject to an anti-viral treatment based on the immune responses of the subject. In one embodiment, the method comprises detecting, in the subject or derivative of the subject, the presence or absence of an immune response against one or more antigens associated with responsiveness to a cancer therapy, applying the rules of the algorithm to the detected immune responses, wherein a subject that satisfies the rules of the algorithm is responsive or partially responsive to the treatment, and a subject that does not satisfy the rules of the algorithm is nonresponsive to the treatment.

In another embodiment, the method comprises detecting, in the subject or derivative of the subject, the presence or absence of an immune response against one or more antigens associated with responsiveness to a cancer therapy, applying the rules of the algorithm to the detected mutations, wherein a score equal to, or greater than the immune response cutoff score indicates that the subject is responsive or partially responsive to the treatment, and a score less than the immune response cutoff score indicates that the subject is nonresponsive to the treatment.

In yet another embodiment, the method comprises detecting, in the subject or derivative of the subject, the presence or absence of an immune response against one or more antigens associated with responsiveness to a cancer therapy, applying the rules of the algorithm to the detected immune responses, wherein a score less than zero indicates that the subject is not likely to respond to the cancer treatment.

6.7 Immunogenic Compositions Comprising Cells Expressing Cytokines

The present invention relates, in part, to methods relating to the effectiveness of cancer therapy with cells genetically altered to express cytokines, e.g., GM-CSF. Cancer therapies with cells genetically altered to express cytokines are extensively described hereinafter.

In one aspect, the method of treating prostate cancer in a subject comprises administering genetically modified cytokine-expressing cells to the subject as part of a therapeutic treatment for cancer. The method can be carried out by genetically modifying (transducing) a first population of tumor cells to produce a cytokine, e.g., GM-CSF, and administering the first population of tumor cells alone or in combination with a second population of tumor cells to the subject. The tumor cells may be tumor cells from the same individual (autologous), from a different individual (allogeneic) or bystander cells (further described below). Typically, the tumor cells are from a tumor cell line of the same type as the tumor or cancer being treated, e.g., the modified cells are prostate or prostate cancer cells and the patient has prostate cancer.

Typically the genetically modified tumor cells are rendered proliferation incompetent prior to administration. In one embodiment, the mammal is a human who harbors prostate tumor cells of the same type as the genetically modified cytokine-expressing tumor cells. In a preferred embodiment, an improved therapeutic outcome is evident following administration of the genetically modified cytokine-expressing tumor cells to the subject. Any of the various parameters of an improved therapeutic outcome for a prostate cancer patient known to those of skill in the art may be used to assess the efficacy of genetically modified cytokine-expressing tumor cell therapy, e.g., a reduction in the serum level of PSA.

In still another aspect, the method is effective to stimulate a systemic immune response in a prostate cancer patient, comprising administering a therapeutically effective amount of proliferation incompetent genetically modified cytokine-expressing cells to the subject. The systemic immune response to the tumor may result in tumor regression or inhibit the growth of the tumor. In some embodiments, the prostate cancer is metastatic prostate cancer. In some embodiments, the prostate cancer is refractory to hormone therapy. In some embodiments, the primary prostate tumor has been treated, e.g., by ablation or rescission and metastases of the primary prostate cancer are treated by immunotherapy as described herein.

In one preferred embodiment, a viral or nonviral vector is utilized to deliver a human GM-CSF transgene (coding sequence) to a human tumor cell ex vivo. After transduction, the cells are irradiated to render them proliferation incompetent. The proliferation incompetent GM-CSF expressing tumor cells are then re-administered to the patient (e.g., by the intradermal or subcutaneous route) and thereby function as a cancer vaccine. The human tumor cell may be a primary tumor cell or derived from a tumor cell line.

In general, the genetically modified tumor cells include one or more of autologous tumor cells, allogeneic tumor cells and tumor cell lines (i.e., bystander cells). The tumor cells may be transduced in vitro, ex vivo or in vivo. Autologous and allogeneic cancer cells that have been genetically modified to express a cytokine, e.g., GM-CSF, followed by readministration to a patient for the treatment of cancer are described in U.S. Pat. Nos. 5,637,483, 5,904,920 and 6,350,445, expressly incorporated by reference herein. A form of GM-CSF-expressing genetically modified tumor cells or a "cytokine-expressing cellular vaccine" ("GVAX"®), for the treatment of pancreatic cancer is described in U.S. Pat. Nos. 6,033,674 and 5,985,290, expressly incorporated by reference herein. A universal immunomodulatory genetically modified bystander cell line is described in U.S. Pat. No. 6,464,973, expressly incorporated by reference herein.

An allogeneic form of GVAX® wherein the cellular vaccine comprises one or more prostate tumor cell lines selected from the group consisting of DU145, PC-3, and LNCaP is described in WO/0026676, expressly incorporated by reference herein. LNCaP is a PSA-producing prostate tumor cell line, while PC-3 and DU-145 are non-PSA-producing prostate tumor cell lines (Pang S. et al., Hum Gene Ther. 1995 November; 6(11):1417-1426).

Clinical trials employing GM-CSF-expressing cellular vaccines (GVAX®) have been undertaken for treatment of prostate cancer, melanoma, lung cancer, pancreatic cancer, renal cancer, and multiple myeloma. A number of clinical trials using GVAX® cellular vaccines have been described, most notably in melanoma, and prostate, renal and pancreatic carcinoma (Simons J W et al. Cancer Res. 1999; 59:5160-5168; Simons J W et al. Cancer Res 1997; 57:1537-1546; Soiffer R et al. Proc. Natl. Acad. Sci USA 1998; 95:13141-13146; Jaffee, et al J Clin Oncol 2001; 19:145-156; Salgia et al. J Clin Oncol 2003 21:624-30; Soiffer et al. J Clin Oncol 2003 21:3343-50; Nemunaitis et al. J Natl Cancer Inst. 2004 Feb. 18 96(4):326-31).

By way of example, in one approach, genetically modified GM-CSF expressing tumor cells are provided as an allogeneic or bystander cell line and one or more additional cancer therapeutic agents is included in the treatment regimen. In another approach, one or more additional transgenes are expressed by an allogeneic or bystander cell line while a cytokine (i.e., GM-CSF) is expressed by autologous or allogeneic cells. The GM-CSF coding sequence is introduced into the tumor cells using a viral or non-viral vector and routine methods commonly employed by those of skill in the art. The preferred coding sequence for GM-CSF is the genomic sequence described in Huebner K. et al., Science 230(4731):1282-5, 1985, however, in some cases the cDNA form of GM-CSF finds utility in practicing the methods (Cantrell et al., Proc. Natl. Acad. Sci., 82, 6250-6254, 1985).

The genetically modified tumor cells can be cryopreserved prior to administration. Preferably, the genetically modified tumor cells are irradiated at a dose of from about 50 to about 200 rads/min, even more preferably, from about 120 to about 140 rads/min prior to administration to the patient. Preferably, the cells are irradiated with a total dose sufficient to inhibit substantially 100% of the cells from further proliferation. Thus, desirably the cells are irradiated with a total dose of from about 10,000 to 20,000 rads, optimally, with about 15,000 rads. Typically more than one administration of cytokine (e.g., GM-CSF) producing cells is delivered to the subject in a course of treatment. Dependent upon the particular course of treatment, multiple injections may be given at a single time point with the treatment repeated at various time intervals. For example, an initial or "priming" treatment may be followed by one or more "booster" treatments. Such "priming" and "booster" treatments are typically delivered by the same route of administration and/or at about the same site. When multiple doses are administered, the first immunization dose may be higher than subsequent immunization doses. For example, a $5 \times 10^6$ prime dose may be followed by several booster doses of $10^6$ to $3 \times 10^6$ GM-CSF producing cells.

A single injection of cytokine-producing cells is typically between about $10^6$ to $10^8$ cells, e.g., $1 \times 10^6$, $2 \times 10^6$, $3 \times 10^6$, $4 \times 10^6$, $5 \times 10^6$, $6 \times 10^6$, $7 \times 10^6$, $8 \times 10^6$, $9 \times 10^6$, $10^7$, $2 \times 10^7$, $5 \times 10^7$, or as many as $10^8$ cells. In one embodiment, there are between $10^6$ and $10^8$ cytokine-producing cells per unit dose. The number of cytokine-producing cells may be adjusted according, for example, to the level of cytokine produced by a given cytokine producing cellular vaccine.

In some embodiments, cytokine-producing cells are administered in a dose that is capable of producing at least 500 ng of GM-CSF per 24 hours per one million cells. Determination of optimal cell dosage and ratios is a matter of routine determination and within the skill of a practitioner of ordinary skill, in light of the disclosure provided herein.

In treating a prostate cancer patient according to the methods described herein, the attending physician may administer lower doses of the cytokine-expressing tumor cell vaccine and observe the patient's response. Larger doses of the cytokine-expressing tumor cell vaccine may be administered until the an improved therapeutic outcome is evident.

Cytokine-producing cells of the invention are processed to remove most additional components used in preparing the cells. In particular, fetal calf serum, bovine serum components, or other biological supplements in the culture medium are removed. In one embodiment, the cells are washed, such as by repeated gentle centrifugation, into a suitable pharmacologically compatible excipient. Compatible excipients include various cell culture media, isotonic saline, with or without a physiologically compatible buffer, for example, phosphate or herpes, and nutrients such as dextrose, physiologically compatible ions, or amino acids, particularly those devoid of other immunogenic components. Carrying reagents, such as albumin and blood plasma fractions and inactive thickening agents, may also be used.

6.7.1. Autologous Cells

The use of autologous genetically modified GM-CSF expressing cells provides advantages since each patient's tumor expresses a unique set of tumor antigens that can differ from those found on histologically-similar, MHC-matched tumor cells from another patient. See, e.g., Kawakami et al., J. Immunol., 148, 638-643 (1992); Darrow et al., J. Immunol., 142, 3329-3335 (1989); and Hom et al., J. Immunother., 10, 153-164 (1991). In contrast, MHC-matched tumor cells provide the advantage that the patient need not be taken to surgery to obtain a sample of their tumor for genetically modified tumor cell production.

In one preferred aspect, the method of treating prostate cancer comprises: (a) obtaining tumor cells from a mammalian subject harboring a prostate tumor; (b) genetically modifying the tumor cells to render them capable of producing an increased level of GM-CSF relative to unmodified tumor cells; (c) rendering the modified tumor cells proliferation incompetent; and (d) readministering the genetically modified tumor cells to the mammalian subject from which the tumor cells were obtained or to a mammal with the same MHC type as the mammal from which the tumor cells were obtained. The administered tumor cells are autologous and MHC-matched to the host. Preferably, the composition is administered intradermally, subcutaneously or intratumorally to the mammalian subject.

In some cases, a single autologous tumor cell may express GM-CSF alone or GM-CSF plus one or more additional transgenes. In other cases, GM-CSF and the one or more additional transgenes may be expressed by different autologous tumor cells. In one aspect of the invention, an autologous tumor cell is modified by introduction of a vector comprising a nucleic acid sequence encoding GM-CSF, operatively linked to a promoter and expression/control sequences necessary for expression thereof. In another aspect, the same autologous tumor cell or a second autologous tumor cell can be modified by introduction of a vector comprising a nucleic acid sequence encoding at least one additional transgene operatively linked to a promoter and expression/control sequences necessary for expression thereof. The nucleic acid sequence encoding the one or more transgenes can be introduced into the same or a different autologous tumor cell using the same or a different vector. The nucleic acid sequence encoding the transgene(s) may or may not further comprise a selectable marker sequence operatively linked to a promoter. Desirably, the autologous tumor cell expresses high levels of GM-CSF.

6.7.2. Allogeneic Cells

Researchers have sought alternatives to autologous and MHC-matched cells as tumor vaccines, as reviewed by Jaffee et al., Seminars in Oncology, 22, 81-91 (1995). Early tumor vaccine strategies were based on the understanding that the vaccinating cells function as the antigen presenting cells (APCs) that present tumor antigens on their MHC class I and II molecules, and directly activate the T cell arm of the immune system. The results of Huang et al. (Science, 264, 961-965, 1994), indicate that professional APCs of the host rather than the vaccinating cells prime the T cell arm of the immune system by secreting cytokine(s) such as GM-CSF such that bone marrow-derived APCs are recruited to the region of the tumor. The bone marrow-derived APCs take up the whole cellular protein of the tumor for processing, and then present the antigenic peptide(s) on their MHC class I and II molecules, thereby priming both the CD4+ and the CD8+ T cell arms of the immune system, resulting in a systemic tumor-specific anti-tumor immune response. Without being bound by theory, these results suggest that it may not be necessary or optimal to use autologous or MHC-matched cells in order to elicit an anti-cancer immune response and that the transfer of allogeneic MHC genes (from a genetically dissimilar individual of the same species) can enhance tumor immunogenicity. More specifically, in certain cases, the rejection of tumors expressing allogeneic MHC class I molecules has resulted in enhanced systemic immune responses against subsequent challenge with the unmodified parental tumor. See, e.g., Jaffee et al., supra, and Huang et al., supra.

As used herein, a "tumor cell line" comprises cells that were initially derived from a tumor. Such cells typically exhibit indefinite growth in culture. In one aspect, the method for treating prostate cancer comprises: (a) obtaining a tumor cell line; (b) genetically modifying the tumor cell line to render the cells capable of producing an increased level of a cytokine, e.g., GM-CSF, relative to the unmodified tumor cell line; (c) rendering the modified tumor cell line proliferation incompetent; and (d) administering the tumor cell line to a mammalian subject (host) having at least one tumor that is of the same type of tumor as that from which the tumor cell line was obtained. In some embodiments, the administered tumor cell line is allogeneic and is not MHC-matched to the host. Such allogeneic lines provide the advantage that they can be prepared in advance, characterized, aliquoted in vials containing known numbers of transgene (e.g., GM-CSF) expressing cells and stored (i.e. frozen) such that well characterized cells are available for administration to the patient. Methods for the production of genetically modified allogeneic cells are described for example in WO 00/72686, expressly incorporated by reference herein.

In one approach to preparing genetically modified GM-CSF expressing allogeneic cells, a nucleic acid sequence (transgene) encoding GM-CSF alone or in combination with the nucleic acid coding sequence for one or more additional transgenes is introduced into a cell line that is an allogeneic tumor cell line (i.e., derived from an individual other than the individual being treated). In another approach, a nucleic acid sequence (transgene) encoding GM-CSF alone or in combination with the nucleic acid coding sequence for one or more additional transgenes is introduced into separate allogeneic tumor cell lines. In yet another approach two or more different genetically modified allogeneic GM-CSF expressing cell lines (e.g. LNCAP and PC-3) are administered in combination, typically at a ratio of 1:1. In general, the cell or population of cells is from a tumor cell line of the same type as the tumor or cancer being treated, e.g. prostate cancer. The nucleic acid sequence encoding the transgene(s) may be introduced into the same or a different allogeneic tumor cell using the same or a different vector. The nucleic acid sequence encoding the transgene(s) may or may not further comprise a selectable marker sequence operatively linked to a promoter. Desirably, the allogeneic cell line expresses high levels of GM-CSF.

In another aspect, one or more genetically modified GM-CSF expressing allogeneic cell lines can be exposed to an antigen, such that the patient's immune response to the antigen is increased in the presence of GM-CSF, e.g., an allogeneic or bystander cell that has been genetically modified to express GM-CSF. Such exposure may take place ex vivo or in vivo. In one preferred embodiment, the antigen is a peptide comprising an amino acid sequence obtained from filamin-B, as described extensively above. In such cases, the composition can be rendered proliferation-incompetent, typically by irradiation, wherein the allogeneic cells are plated in a tissue culture plate and irradiated at room temperature using a Cs source, as further described herein. An allogeneic cellular vaccine composition of the invention may comprise allogeneic cells plus other cells, i.e. a different type of allogeneic cell, an autologous cell, or a bystander cell that may or may not be genetically modified. If genetically modified, the different type of allogeneic cell, autologous cell, or bystander cell may express GM-CSF or another transgene. The ratio of allogeneic cells to other cells in a given administration will vary dependent upon the combination.

Any suitable route of administration can be used to introduce an allogeneic cell line composition into the patient, preferably, the composition is administered intradermally, subcutaneously or intratumorally.

The use of allogeneic cell lines in practicing the present invention provides the therapeutic advantage that administration of a genetically modified GM-CSF expressing cell line to a patient with cancer, together with an autologous cancer antigen, paracrine production of GM-CSF results in an effective immune response to a tumor. This obviates the need to culture and transduce autologous tumor cells for each patient.

6.7.3. Bystander Cells

In one further aspect, a universal immunomodulatory genetically modified transgene-expressing bystander cell that expresses at least one transgene can be used in the immunotherapies described herein. The same universal bystander cell line may express more than one transgene or individual transgenes may be expressed by different universal bystander cell lines. The universal bystander cell line comprises cells which either naturally lack major histocompatibility class I (MHC-I) antigens and major histocompatibility class II (MHC-II) antigens or have been modified so that they lack MHC-I antigens and MHC-II antigens. In one aspect, a universal bystander cell line can be modified by introduction of a vector wherein the vector comprises a nucleic acid sequence encoding a transgene, e.g., a cytokine such as GM-CSF, operably linked to a promoter and expression control sequences necessary for expression thereof. In another aspect, the same universal bystander cell line or a second a universal bystander cell line is modified by introduction of a vector comprising a nucleic acid sequence encoding at least one additional transgene operatively linked to a promoter and expression control sequences necessary for expression thereof. The nucleic acid sequence encoding the transgene(s) may be introduced into the same or a different universal bystander cell line using the same or a different vector. The nucleic acid sequence encoding the transgene(s) may or may not further comprise a selectable marker sequence operatively linked to a promoter. Any combination of transgene(s) that stimulate an anti-tumor immune response can be used. The universal bystander cell line preferably grows in defined, i.e., serum-free medium, preferably as a suspension.

An example of a preferred universal bystander cell line is K562 (ATCC CCL-243; Lozzio et al., Blood 45(3): 321-334 (1975); Klein et al., Int. J. Cancer 18: 421-431 (1976)). A detailed description of the generation of human bystander cell lines is described for example in U.S. Pat. No. 6,464,973, expressly incorporated by reference herein.

Desirably, the universal bystander cell line expresses high levels of the transgene, e.g. a cytokine such as GM-CSF.

In the methods, the one or more universal bystander cell lines can be incubated with an autologous cancer antigen, e.g., provided by an autologous tumor cell (which together comprise a universal bystander cell line composition), then the universal bystander cell line composition can be administered to the patient. Any suitable route of administration can be used to introduce a universal bystander cell line composition into the patient. Preferably, the composition is administered intradermally, subcutaneously or intratumorally.

Typically, the autologous cancer antigen can be provided by a cell of the cancer to be treated, i.e., an autologous cancer cell. In such cases, the composition is rendered proliferation-incompetent by irradiation, wherein the bystander cells and cancer cells are plated in a tissue culture plate and irradiated at room temperature using a Cs source, as detailed above.

The ratio of bystander cells to autologous cancer cells in a given administration will vary dependent upon the combination. With respect to GM-CSF-producing bystander cells, the ratio of bystander cells to autologous cancer cells in a given administration should be such that a therapeutically effective level of GM-CSF is produced. In addition to the GM-CSF threshold, the ratio of bystander cells to autologous cancer cells should not be greater than 1:1. Appropriate ratios of bystander cells to tumor cells or tumor antigens can be determined using routine methods known in the art.

The use of bystander cell lines in practicing the present invention provides the therapeutic advantage that, through administration of a cytokine-expressing bystander cell line and at least one additional cancer therapeutic agent (expressed by the same or a different cell) to a patient with cancer, together with an autologous cancer antigen, paracrine production of an immunomodulatory cytokine, results in an effective immune response to a tumor. This obviates the need to culture and transduce autologous tumor cells for each patient.

Typically a minimum dose of about 3500 rads is sufficient to inactivate a cell and render it proliferation-incompetent, although doses up to about 30,000 rads are acceptable. In some embodiment, the cells are irradiated at a dose of from about 50 to about 200 rads/min or from about 120 to about 140 rads/min prior to administration to the mammal. Typically, when using irradiation, the levels required are 2,500 rads, 5,000 rads, 10,000 rads, 15,000 rads or 20,000 rads. In one embodiment, a dose of about 10,000 rads is used to inactivate a cell and render it proliferation-incompetent. It is understood that irradiation is but one way to render cells proliferation-incompetent, and that other methods of inactivation which result in cells incapable of multiple rounds of cell division but that retain the ability to express transgenes (e.g. cytokines) are included in the present invention (e.g., treatment with mitomycin C, cycloheximide, and conceptually analogous agents, or incorporation of a suicide gene by the cell).

6.7.4. Cytokines

A "cytokine" or grammatical equivalent, includes, without limitation, those hormones that act locally and do not circulate in the blood, and which, when used in accordance with the present invention, will result in an alteration of an individual's immune response. Also included in the definition of cytokine are adhesion or accessory molecules which result in an alteration of an individual's immune response. Thus, examples of cytokines include, but are not limited to, IL-1 (a or P), IL-2, IL-3, IL-4, IL-5, IL-6, IL-7, IL-8, IL-9, IL-10, IL-11, IL-12, GM-CSF, M-CSF, G-CSF, LIF, LT, TGF-β, γ-IFN, a-EFN, P-IFN, TNF-α, BCGF, CD2, or ICAM. Descriptions of the aforementioned cytokines as well as other applicable immunomodulatory agents may be found in "Cytokines and Cytokine Receptors," A. S. Hamblin, D. Male (ed.), Oxford University Press, New York, N.Y. (1993)), or the "Guidebook to Cytokines and Their Receptors," N. A. Nicola (ed.), Oxford University Press, New York, N.Y. (1995)). Where therapeutic use in humans is contemplated, the cytokines will preferably be substantially similar to the human form of the protein or will have been derived from human sequences (i.e., of human origin). In one preferred embodiment, the transgene is a cytokine, such as GM-CSF.

Additionally, cytokines of other mammals with substantial structural homology and/or amino acid sequence identity to the human forms of a given cytokine, will be useful when demonstrated to exhibit similar activity on the human immune system. Similarly, proteins that are substantially analogous to any particular cytokine, but have conservative changes of protein sequence, can also be used. Thus, conservative substitutions in protein sequence may be possible without disturbing the functional abilities of the protein molecule, and thus proteins can be made that function as cytokines in the present invention but have amino acid sequences that differ slightly from currently known sequences. Such conservative substitutions typically include substitutions within the following groups: glycine, alanine, valine, isoleucine, leucine; aspartic acid, glutamic acid, asparagine, glutamine; serine, threonine; lysine, arginine; and phenylalanine, tyrosine.

Granulocyte-macrophage colony stimulating factor (GM-CSF) is a cytokine produced by fibroblasts, endothelial cells, T cells and macrophages. This cytokine has been shown to induce the growth of hematopoetic cells of granulocyte and macrophage lineages. In addition, it also activates the antigen processing and presenting function of dendritic cells, which are the major antigen presenting cells (APC) of the immune system. Results from animal model experiments have convincingly shown that GM-CSF producing cells are able to induce an immune response against parental, non-transduced cells.

GM-CSF augments the antigen presentation capability of the subclass of dendritic cells (DC) capable of stimulating robust anti-tumor responses (Gasson et al. Blood 1991 Mar. 15; 77(6):1131-45; Mach et al. Cancer Res. 2000 Jun. 15; 60(12):3239-46; reviewed in Mach and Dranoff, Curr Opin Immunol. 2000 October; 12(5):571-5). See, e.g., Boon and Old, Curr Opin Immunol. 1997 Oct. 1; 9(5):681-3). Presentation of tumor antigen epitopes to T cells in the draining lymph nodes is expected to result in systemic immune responses to tumor metastases. Also, irradiated tumor cells expressing GM-CSF have been shown to function as potent vaccines against tumor challenge. Localized high concentrations of certain cytokines, delivered by genetically modified cells, have been found to lead to tumor regression (Abe et al., J. Canc. Res. Clin. Oncol. 121: 587-592 (1995); Gansbacher et al., Cancer Res. 50: 7820-7825 (1990); Formi et al., Cancer and Met. Reviews 7: 289-309 (1988). PCT publication WO200072686 describes tumor cells expressing various cytokines.

In one embodiment, the cellular immunogenic composition comprises a GM-CSF coding sequence operatively linked to regulatory elements for expression in the cells of the vaccine. The GM-CSF coding sequence may code for a murine or human GM-CSF and may be in the form of genomic DNA (SEQ ID NO: 152; disclosed as SEQ ID NO: NO.: 1 in US Patent Publication NO. 2006/0057127, which is hereby incorporated by reference in its entirety) or cDNA (SEQ ID NO: 153; disclosed as SEQ ID NO: NO.:2 in US Patent Publication NO. 2006/0057127, which is hereby incorporated by reference in its entirety). In the case of cDNA, the coding sequence for GM-CSF does not contain intronic sequences to be spliced out prior to translation. In contrast, for genomic GM-CSF, the coding sequence contains at least one native GM-CSF intron that is spliced out prior to translation. In one embodiment, the GM-CSF coding sequence encodes the amino acid sequence presented as SEQ ID NO.: 154 (disclosed as SEQ ID NO.:3 in US Patent Publication NO. 2006/0057127, which is hereby incorporated by reference in its entirety). Other examples of GM-CSF coding sequences are found in Genbank accession numbers: AF373868, AC034228, AC034216, M 10663 and NM000758.

A GM-CSF coding sequence can be a full-length complement that hybridizes to the sequence shown in SEQ ID NO:152 or SEQ ID NO:153 under stringent conditions. The phrase "hybridizing to" refers to the binding, duplexing, or hybridizing of a molecule to a particular nucleotide sequence under stringent conditions when that sequence is present in a complex mixture (e.g., total cellular) DNA or RNA. "Bind(s) substantially" refers to complementary hybridization between a probe nucleic acid and a target nucleic acid and embraces minor mismatches that can be accommodated by reducing the stringency of the hybridization media to achieve the desired detection of the target nucleic acid sequence.

It therefore follows that the coding sequence for a cytokine such as GM-CSF, can have at least 80, 85, 87, 89, 90, 91, 92, 93, 94, 95, 96, 97, 98, 99% or more % identity over its entire length to a native GM-CSF coding sequence. For example, a GM-CSF coding sequence can have at least 80, 85, 87, 89, 90, 91, 92, 93, 94, 95, 96, 97, 98, 99% or more sequence identity to a sequence presented as SEQ ID NO: NO:152 or SEQ ID NO: NO:153, when compared and aligned for maximum correspondence, as measured a sequence comparison algorithm (as described above) or by visual inspection. In one embodiment, the given % sequence identity exists over a region of the sequences that is at least about 50 nucleotides in length. In another embodiment, the given % sequence identity exists over a region of at least about 100 nucleotides in length. In another embodiment, the given % sequence identity exists over a region of at least about 200 nucleotides in length. In another embodiment, the given % sequence identity exists over the entire length of the sequence. Preferably, the GM-CSF has authentic GM-CSF activity, e.g., can bind the GM-CSF receptor.

In some embodiments, the amino acid sequence for a cytokine such as GM-CSF has at least 80, 85, 87, 89, 90, 91, 92, 93, 94, 95, 96, 97, 98, 99% or more sequence identity to the sequence presented as SEQ ID NO: NO: 154, when compared and aligned for maximum correspondence.

7. EXAMPLES

The present invention is described by reference to the following Examples, which are offered by way of illustration and are not intended to limit the invention in any manner. Standard techniques well known in the art or the techniques specifically described below are utilized. It will be appreciated that the methods and compositions of the instant invention can be incorporated in the form of a variety of embodiments, only a few of which are disclosed herein. It will be apparent to the artisan that other embodiments exist and do not depart from the spirit of the invention. Thus, the described embodiments are illustrative and should not be construed as restrictive.

Exemplary methods for producing recombinant viral vectors useful for making genetically altered tumor cells that express GM-CSF, methods for using the genetically altered tumor cells that express GM-CSF in cancer therapies, particularly prostate cancer therapies, are extensively described in U.S. Patent Application Publication No. 2006/0057127, incorporated by reference in its entirety, and will not be reproduced below. One such therapy that has been and is being evaluated in clinical trials for treatment of prostate cancer is GVAX® therapy.

7.1 Example 1

Identification of Protein Targets of Host Antibody Responses Following Cell-Based Prostate Cancer Immunotherapy This example describes identification of protein targets of host antibody responses following allogeneic cancer immunotherapy armed with GM-CSF as described above.

Patients [n=19] treated with high-dose cell-based cancer immunotherapy (e.g., 500 million cells followed by 300 million cells every two weeks) demonstrate an increase in median survival time (MST). The median survival has not yet been reached for this high dose group, and the final median survival will be no less than 29.1 months based on the current median follow-up time for these patients. In addition, there was also a statistically significant increased antibody response to the cell-based cancer immunotherapy in the high dose group with detectable antibodies directed against antigens derived from the immunotherapy as determined by western blot analysis using patient sera harvested post-immunization.

Humoral patient immune responses to a cell-based prostate cancer immunotherapy have been evaluated to specifically identify which antigens may be specifically recognized by the patients' immune system following the therapy. Two differing methods have been used to characterize this response using patients' sera: i) serological analysis of gene expression libraries (SEREX) and ii) defined prostate cancer antigen screening. From these two techniques, multiple antibody responses to proteins derived from the immunotherapy have been identified that are specifically induced or augmented following immunization.

7.1.1. Serological Analysis of Gene Expression Libraries (SEREX)

SEREX allows the systematic cloning of tumor antigens recognized by the autoantibody repertoire of cancer patients (Sahin et al. 1995; McNeel et al. 2000; Wang et al. 2005; Dunphy et al. 2005; Qin et al. 2006). cDNA expression libraries were constructed from the tumor cell lines used to comprise the GVAX® immunotherapy (PC-3 and LNCaP prostate cancer cell lines modified to secrete GM-CSF), packaged into lambda-phage vectors, and expressed recombinantly in *E. Coli*. Recombinant proteins expressed during the lytic infection of bacteria were then blotted onto nitrocellulose membranes and probed with diluted patient serum for identification of clones reactive with high-titered IgG antibodies.

This procedure was carried out for 8 patients treated with cell-based prostate cancer immunotherapy. These patients were prioritized for SEREX analysis based upon survival advantage. Survival advantage was determined by comparing individual patient survival time to a patient's predicted survival. Predicted survival was calculated using a published, validated nomogram based on seven prognostic variables including PSA, ECOG performance status, Gleason score sum, alkaline phosphatase, hemoglobin, LDH and presence/absence of visceral metastatic disease (Halabi, et al. 2003). From the SEREX analysis of these 8 patients, multiple LNCaP/PC-3 derived cell protein clones reactive to the patient sera post-immunotherapy were identified. Positive hits for the SEREX screen were then screened against pre-immunotherapy serum to determine if the antibody response to these proteins was augmented or induced following the immunotherapy.

For example, from patient 1, 24 proteins from an original list of 92 individual proteins (26%) have antibody responses that were induced upon GVAX® immunotherapy. The remainder of the responses (68 proteins) did not demonstrate an increase in titer. For patient 2, 18 individual proteins from a total of 47 (38%) had induced antibody titers following immunotherapy. For patient 3, 14/38 (37%) of antibody responses were induced following immunotherapy. Table 1, below, provides a compiled list of induced antibody hits (143 proteins total) for all 8 patients screened by SEREX.

TABLE 1

| Hit pulled out using what post serum? | X# | Plugs Came From Which Lib? | Gene |
|---|---|---|---|
| Patient 1 | X1 | L, L, L | ACAT2 (acetyl-Coenzyme A acetyltransferase 2) |
| | X2 | P, P | ACAA1 |
| | X3 | P | cDNA FLJ41756 fis |
| | X4 | gP | cDNA: FLJ22465 fis |
| | X5 | P, P | chromosome 20 open reading frame 43 |
| | X6 | P | exosome component 5 (EXOSC5) |
| | X7 | P, gP, gP | Huntingtin interacting protein K (HYPK) |
| | X8 | P | keratin 10 (KRT10) |
| | X9 | gP, gP | Methylenetetrahydrofolate dehydrogenase (MTHFD1) |
| | X10 | gP | mitochondrial ribosomal protein L32 |
| | X11 | L, L | M-phase phosphoprotein 10 (MPHOSPH10) |
| | X12 | gP, P | RAP1 interacting factor homolog (yeast) (RIF1) |
| | X13 | gP | restin (RSN) |
| | X14 | P | RNA binding motif protein 4 (RBM4) |
| | X15 | gP, P, P | S100 calcium binding protein A2 (S100A2) |
| | X16 | L | selenium binding protein 1 (SELENBP1) |
| | X17 | gP, gP | SVH protein (SVH) |
| | X18 | gP, L | translocated promoter region (to activated MET oncogene) |
| | X19 | gP | BRCC1 (BRCC1) |
| | X20 | gP | nucleophosmin (NPM1) |
| | X21 | gP | COP9 constitutive photomorphogenic homolog subunit 3 |
| | X22 | P, P | kinesin family member 15 (KIF15) |
| | X23 | L | zinc finger protein 24 (KOX 17) (ZNF24) |
| | X24 | P, L | golgi autoantigen macrogolgin (with transmembrane signal) (GOLGB1) |
| Patient 2 | X25 | P, P, P | HLA |
| | X26 | P | 18S rRNA gene |
| | X27 | P, P, P | Bcl-XL-binding protein v68 (MGC5352) |
| | X28 | P, P | Cullin-associated and neddylation-dissociated 1 (CAND1) |
| | X29 | P | heat shock 60 kDa protein 1 (chaperonin) (HSPD1) |
| | X30 | L, P, P | hypothetical protein FLJ10534 |
| | X31 | P | MAX gene associated (MGA) (PREDICTED) |
| | X32 | P, P, P | Molybdenum cofactor sulfurase (MOCOS) |
| | X33 | P | peroxisomal D3,D2-enoyl-CoA isomerase (PECI) |
| | X34 | L, P, P | ribonuclease III, nuclear (RNASEN) |
| | X35 | P, P, P | RNA binding motif protein 25 (RBM25) |
| | X36 | P, P, P | Sjogren's syndrome/scleroderma autoantigen 1 |
| | X37 | P, P | SVH protein (SVH) |
| | X38 | P | TSR1, 20S rRNA accumulation, homolog (yeast) (TSR1) |
| | X39 | gP, P, P | RNA binding motif protein 25 (RBM25) |
| | X40 | P | deltex 3-like (*Drosophila*) (DTX3L) |
| | X41 | P, L, P | recombining binding protein suppressor of hairless |
| | X42 | P | coiled-coil domain containing 18 (CCDC18) |
| Patient 3 | X43 | P | centromere protein F, 350/400ka (mitosin) (CENPF) |
| | X44 | L | chromosome 1 open reading frame 80 (C1orf80) |
| | X45 | L, L, L | cleavage and polyadenylation specific factor 2 (CPSF2) |
| | X46 | L | enoyl Coenzyme A hydratase 1, peroxisomal (ECH1) |
| | X47 | | filamin B, beta (actin binding protein 278) (FLNB) |
| | X48 | L, P, P | G elongation factor, mitochondrial 2 (GFM2) |
| | X49 | L, P, P | heat shock 60 kDa protein 1 (chaperonin) (HSPD1) |
| | X50 | L | heat shock 70 kDa protein 8 (HSPA8), transcript variant 2 |
| | X51 | L, P | heat shock 70 kDa protein 9B (mortalin-2) (HSPA9B) |
| | X52 | P, L, L | InaD-like (*Drosophila*) (INADL) |
| | X53 | L | Jumonji |
| | X54 | L | mRNA for mitotic kinesin-like protein-1 (MKLP-1 gene) |
| | X55 | L, P, P | Restin (RSN) |
| | X56 | L | Ubiquinol-cytochrome c reductase hinge protein (UQCRH) |
| Patient 4 | X58 | L | PNPO |
| Patient 5 | X60 | gP, gL, P | chaperonin containing TCP1, subunit 5 (epsilon) (CCT5) |
| | X61 | L, gL, gP | chromosome 10 open reading frame 118 (C10orf118) |
| | X62 | gL, gP | enoyl Coenzyme A hydratase 1, peroxisomal (ECH1) |
| | X63 | P | Eukaryotic translation initiation factor 3, subunit 9 eta, 116 kDa (EIF3S9) |
| | X64 | gL, P | Filamin B, beta (actin binding protein 278) (FLNB) |
| | X65 | gL, gL, L | heterogeneous nuclear ribonucleoprotein K (HNRPK), var 1 |
| | X66 | gL, gP, P | Huntingtin interacting protein K (HYPK) |
| | X67 | P | hypothetical protein FLJ14668 (FLJ14668) |
| | X68 | L, gP, L | hypothetical protein FLJ21908 (FLJ21908) |
| | X69 | L | interleukin enhancer binding factor 3, 90 kDa (ILF3), var 1 |
| | X70 | P | KIAA0310 |

TABLE 1-continued

| Hit pulled out using what post serum? | X# | Plugs Came From Which Lib? | Gene |
|---|---|---|---|
| | X71 | gP | membrane-associated ring finger (C3HC4) 6 (MARCH6) |
| | X72 | P, gL, gP | methylmalonyl Coenzyme A mutase (MUT) |
| | X73 | gL, gP, P | M-phase phosphoprotein 10 (MPHOSPH10) |
| | X74 | gL, L | myosin, heavy polypeptide 10, non-muscle (MYH10) |
| | X75 | gP | neuroblastoma breakpoint family, member 9, variant 13 (NBPF9)-predicted |
| | X76 | L | non-metastatic cells 1, protein (NM23A) expressed in (NME1), var 1 |
| | X77 | P, P | NSFL1 (p97) cofactor (p47) (NSFL1C), var 1 |
| | X78 | P | Rho-associated, coiled-coil containing protein kinase 2 (ROCK2) |
| | X79 | L | ribosomal protein S15a (RPS15A), var 1 |
| | X80 | gP, gP, P | translocase of outer mitochondrial membrane 70 homolog A (TOMM70A) |
| | X81 | gP | upstream binding transcription factor, RNA polymerase I (UBTF) |
| | X82 | L, L | YTH domain containing 2 (YTHDC2) |
| Patient 6 | X83 | gP | coiled-coil domain containing 46 (CCDC46), var 1 |
| | X84 | gP | KIAA0196 |
| | X85 | gP | ribosomal protein L21 (RPL21) |
| | X86 | gP, gL, L | SWI/SNF related, matrix assoc., actin dependent reg of chromatin (SMARCA3) |
| | X87 | P | thyroid hormone receptor interactor 12 (TRIP12) |
| Patient 7 | X92 | | disrupter of silencing 10 (SAS10) |
| | X94 | | heat shock 60 kDa protein 1 (chaperonin) (HSPD1) |
| | X96 | | high-mobility group box 2 (HMGB2) |
| | X97 | | interphase cyctoplasmic foci protein 45 (ICF45) |
| | X100 | | LSM3 homolog, U6 small nuclear RNA associated (LSM3) |
| | X101 | | methylmalonyl Coenzyme A mutase (MUT) |
| | X102 | | NSFL1 (p97) cofactor (p47) (NSFL1C) |
| | X103 | | par-3 partitioning defective 3 homolog (*C. elegans*) (PARD3) |
| | X105 | | proteasome (prosome, macropain) 26S subunit, non-ATPase, 2 (PSMD2) |
| | X107 | | SVH protein (SVH) |
| | X108 | | TAO kinase 3 (TAOK3) |
| | X110 | | golgi autoantigen, macrogolgin (with transmembrane signal), 1 (GOLGB1) |
| | X111 | | heat shock 70 kDa protein 8 (HSPA8) |
| Patient 8 | X113 | L | kinetochore associated 2 (KNTC2) |
| | X118 | PIT | opioid growth factor receptor (OGFR) |
| | X120 | P, P | nexilin (F actin binding protein) (NEXN) |
| | X125 | L | NSFL1 (p97) cofactor (p47) (NSFL1C) |
| | X126 | L, L | hypothetical protein FLJ21908 (FLJ21908) |
| | X128 | L, P | NADH dehydrogenase (ubiquinone) flavoprotein 2, 24 kDa (NDUFV2) |
| | X130 | P | chromosome 14 DNA sequence BAC C-2555O16 (see note for rest) |
| | X131 | L, P | ankyrin repeat and KH domain containing 1 (ANKHD1)/(MASK-BP3) |
| | X132 | L, L | heterogeneous nuclear ribonucleoprotein K (HNRPK) |
| | X133 | L, P | kinesin family member 15 (KIF15) |
| | X134 | L | translocated promoter region (to activated MET oncogene) (TPR) |
| | X135 | L, L | acetyl-Coenzyme A acetyltransferase 2(ACAT2) |
| | X136 | L, P | Huntingtin interacting protein K (HYPK) |
| | X137 | L | InaD-like (*Drosophila*) (INADL) |
| Patient 4 cont. | X138 | L, P | ring finger protein 8 (RNF8) |
| | X139 | L, P | colony stimulating factor 2 (granulocyte-macrophage) (CSF2) |
| | X141 | L | A kinase (PRKA) anchor protein (yotiao) 9 (AKAP9) |

7.1.2. Expanded Analysis of Induced Autoantibody Responses

Employing the compiled list of 143 proteins to which autoantibody responses were observed from the 8 patients, samples from a larger cohort of patients (up to 14 in total) were screened to determine the frequency and selectivity of antibody responses. Representative phage clones of each of the 143 proteins were screened against patient sera pre and post-immunotherapy. Results for all 8 patients from which the clones were originally isolated, are presented in Tables 2 and 3, below.

Results from this expanded screen of patients sera indicate that for a number of proteins, auto-antibodies are induced at a relatively high frequency following immunotherapy. For interpretation, these antigens have been grouped into 2 classes as shown in Tables 2 and 3, below. Although grouped separately for presentation purposes, both groups of genes (de novo and induced) may serve as an important marker of clinical benefit in patients.

De novo antigens (Table 2), were antibody responses that are not detectable pre-therapy in any patient screened so far, but are present in at least 2 (of the 14 patients screened) following immunotherapy. Response is absolute (on/off).

"Induced" antigens (Table 3), were antibody responses that are detectable pre-therapy in a proportion of patients and titer is increased in at least 2 patients post-therapy (enhancement of pre-existing antibody response).

TABLE 2

De novo antibody responses

| Gene | Genbank accession number | Frequency of autoantibody induction Following GVAX ® |
|---|---|---|
| HLA-A gene, HLA-A24 allele | NM_002116 | 8/13 (62%) |
| Filamin B, beta (FLNB) | NM_001457 | 7/12 (58%) |
| NSFL1 (p97) cofactor (p47) (NSFL1C) | NM_016143 | 3/6 (50%) |
| Pyridoxine 5'phosphate oxidase (PNPO) | NM_018129 | 6/13 (46%) |
| SVH protein (SVH) | NM_031905 | 4/9 (44%) |
| Heat shock 60 kDa (HSPD1) | NM_002156 | 4/9 (44%) |
| YTH domain containing 2 (YTHDC2) | NM_022828 | 3/10 (30%) |
| Chaperonin containing TCP1, subunit 5 (CCT5) | NM_012073 | 3/10 (30%) |
| KIAA0196 | NM_014846 | 2/7 (29%) |
| InaD-like (*Drosophila*) (INADL) | NM_176878 | 3/12 (25%) |
| Translocated promoter region (to activated MET oncogene) (TPR) | NM_003292 | 2/8 (25%) |
| Disrupter of silencing 10 (SAS10) | NM_020368 | 2/8 (25%) |
| Enoyl Coenzyme A hydratase 1, peroxisomal (ECH1) | NM_001398 | 3/13 (23%) |
| Heat shock 70 kDa protein 8 (HSPA8) | NM_006597/153201 | 2/9 (22%) |
| Methylmalonyl Coenzyme A mutase (MUT) | NM_000255 | 2/9 (22%) |
| LSM3 homolog, U6 small nuclear RNA associated (LSM3) | NM_014463 | 2/9 (22%) |
| Dihydrolipoamide S-acetyltransferase (DLAT) | NM_001931 | 2/9 (22%) |
| Huntingtin interacting protein K (HYPK) | NM_016400 | 3/14 (21%) |
| Non-metastatic cells 1, protein (NM23A) expressed in (NME1) | NM_000269/198175 | 2/10 (20%) |
| KIAA0310 | XM_946064 | 2/10 (20%) |
| Eukaryotic translation initiation factor 3, subunit 9 eta, 116 kDa (EIF3S9) | NM_001037283/003751 | 2/10 (20%) |
| Acetyl-Coenzyme A acetyltransferase 2 (ACAT2) | NM_005891 | 2/14 (18%) |
| Proteasome (prosome, macropain) 26S subunit, non-ATPase, 2 (PSMD2) | NM_002808 | 2/11 (18%) |
| Kinetochore associated 2 (KNTC2) | NM_006101 | 2/11 (18%) |
| Interphase cytoplasmic protein 45 (ICF45) | NM_017872 | 2/13 (15%) |
| Translocated promoter region (to activated MET oncogene) | NM_003292 | 2/13 (15%) |
| RAP1 interacting factor homolog (yeast) (RIF1) | NM_018151 | 2/13 (15%) |

TABLE 3

Induced antibody responses

| Gene | Genbank accession number | Frequency of pre-existing, un-augmented autoantibody response | Frequency of autoantibody induction Following GVAX ® |
|---|---|---|---|
| M-phase phosphoprotein 10 (MPHOSPH10) | NM_005791 | 5/14 | 8/14 (57%) |
| TAO Kinase 3 (TAOK3) | NM_016281 | 4/9 | 5/9 (55%) |
| Upstream binding transcription factor, RNA polymerase 1 (UBTF) | NM_014233 | 5/10 | 5/10 (50%) |
| Jumonji, AT rich interactive domain 1A (RBBP2-like) (JARID1A) | NM_005056 | 6/12 | 5/12 (41%) |
| Rho-associated, coiled-coil containing protein kinase 2 (ROCK2) | NM_004850 | 6/9 | 3/9 (33%) |
| Golgi autoantigen, macrogolgin (with transmembrane signal), 1 (GOLGB1) | NM_004487 | 6/9 | 3/9 (33%) |
| Bcl-XL-binding protein v68 (MGC5352) | NM_138575 | 3/13 | 4/13 (31%) |
| Mitochondrial ribosomal protein L32 (MRPL32) | NM_031903 | 10/14 | 4/14 (29%) |
| Kinesin family member 15 (KIF15) | NM_020242 | 1/14 | 4/14 (29%) |
| Centromere protein F, 350/400ka (mitosin) (CENPF) | NM_016343 | 2/12 | 3/12 (25%) |
| Membrane-associated ring finger (C3HC4) 6 (MARCH6) | NM_005885 | 3/8 | 2/8 (25%) |
| Coiled-coil domain containing 46 (CCDC46), var 1 | NM_001037325 NM_1455036 | 2/9 | 2/9 (22%) |
| Restin (Reed-Steinberg cell-expressed intermediate filament-associated protein) (RSN) | NM_198240 | 2/11 (18%) | 2/11 (18%) |
| Coiled-coil domain containing 18 (CCDC18) | NM_206886 | 4/11 | 2/11 (18%) |
| Acetyl-Coenzyme A acyltransferase 1 (ACAA1) | NM_001607 | 1/14 | 2/14 (14%) |

Therefore, in patients treated with cell-based prostate cancer immunotherapy, a number of autoantibody responses are induced at a relatively high frequency (FLNB, SVH, HSPD1, MPHOSPH10, etc.).

7.1.3. Cloning and Characterization of Antigens

The following list identifies to top 20 most frequent antibody responses (from both the de novo and induced gene lists):

TABLE 4

1. HLA-A gene, HLA-A24 allele
2. Filamin B, beta (FLNB)
3. M-phase phosphoprotein 10 (MPHOSPH10)
4. TAO Kinase 3 (TAOK3)
5. NSFL1 (p97) cofactor (p47) (NSFL1C)
6. Upstream binding transcription factor, RNA polymerase 1 (UBTF)
7. Pyridoxine 5'phosphate oxidase (PNPO)
8. SVH protein (SVH)
9. Heat shock 60 kDa (HSPD1)
10. Jumonji, AT rich interactive domain 1A (RBBP2-like) (JARID1A)
11. Bcl-XL-binding protein v68 (MGC5352)
12. YTH domain containing 2 (YTHDC2)

TABLE 4-continued

13. Chaperonin containing TCP1, subunit 5 (CCT5)
14. Kinesin family member 15 (KIF15)
15. InaD-like (Drosophila) (INADL)
16. Enoyl Coenzyme A hydratase 1, peroxisomal (ECH1)
17. Huntingtin interacting protein K (HYPK)
18. Non-metastatic cells 1, protein (NM23A) expressed in (NME1)
19. Acetyl-Coenzyme A acetyltransferase 2 (ACAT2)
20. Methylmalonyl Coenzyme A mutase (MUT)

Full length genes are cloned into a mammalian based expression system (e.g., a lentiviral expression plasmid) and a FLAG-tag is added at the C-terminal end to aid with detection and purification. Antibody responses to these high frequency hits of 20 proteins are determined from all trials available (G98-03, G0010, VITAL-1/2) and the induction of antibody response is examined in correlation to survival. These responses either alone, or grouped with the defined antigen responses discussed below, are used for a number of applications including a surrogate marker of immunotherapy treatment, correlation with patient survival data to provide an efficacy signature, clinical trial monitoring (biomarkers) and assay development of cell characterization marker for lot release (product characterization, comparability markers).

Certain of the above-identified antigens were cloned and characterized as set forth below.

7.1.3.1 Cloning, Protein Production and Antibody Response to FLNB in Patients Administered a Cell-Based Prostate Cancer Immunotherapy FLNB was cloned with a C-terminus Flag tag into a lentivirus plasmid vector for protein production. To generate the plasmid a FLNB intermediate was first cloned which contained the 3'end of FLNB attached to C-terminal Flag tag sequence (in frame). To generate this clone, a PCR fragment was generated using the forward primer (5'-actacctgatcagtgtcaaa-3') SEQ ID NO: 161 and the reverse primer (5'-gtaatctccggaaggcactgtgacatgaaaag-3') SEQ ID NO: 162 using a FLNB template obtained from Invitrogen (clone CS0DK001YE14) and High Fidelity Expand PCR kit (Roche). The resulting PCR product was cleaned by Qiagen PCR Purification kit, digested with BspE1 and then ligated into a parental lentivirus plasmid vector pKCCMVp53flag which was previously digested with Sma1 and BspE1. To generate the full length FLNB Flag tag vector, the following fragments were ligated together: the Age1 to Sal1 fragment from pKCCMVGFP, the BspE1 to Bcl1 fragment from the Invitrogen FLNB clone CS0DK001YE14, and the Bcl1 to Sal1 fragment from the FLNB intermediate described above. The vector construct called pKCCMVFLNBflag was fully sequenced.

To express FLNB, Flag-tagged FLNB was produced in mammalian cells and purified using affinity purification. In brief, twenty-four hours before transfection, 10 75 cm$^2$ plates were seeded with 5×10$^6$ cells/plate HEK293 cells. Twenty-four hours later, cells were transfected with 10 μg/plate of pKCCMVFLNBflag using a calcium phosphate transfection kit (Clontech). Three days post-transfection cells were lysed with cell lysis buffer (+protease inhibitors) and FLNB protein purified using Anti-Flag M2 affinity columns (Sigma) according to manufacturing instructions.

For western blot analysis of patients antibodies to filamin B, 150 ng of purified filamin B was separated on a Tris-Glycine gel (Invitrogen) under reducing conditions and transferred to a nitrocellulose membrane. Blots were then blocked overnight with 3% nonfat dry milk in TBS and incubated with a 1:500 dilution of patients serum post-therapy for 3 hours. Blots were then washed in TBST and incubated with an IgG/IgM specific donkey anti-human secondary antibody conjugated to horseradish peroxidase for an hour and a half. Following TBST washes immunoreactive bands were visualized by exposure of photographic film (Kodak) after the blots were treated with the ECL enhanced chemiluminescence system (Pierce). Patients 1, 3, 4, and 5 an immunoreactive band at 280 kDa running at the predicted molecular weight could be observed in the post-therapy serum samples, while immunoreactivity was absent in pre-therapy samples.

Patient antibodies to FLNB were also monitored in an ELISA. To do so, 96 well plates were coated with 250 ng/well of purified FLNB overnight in bicarbonate buffer (coating buffer). Next day, wells were washed with PBST and then blocked using 1% BSA in PBST for 3 hours at room temperature. Following blocking, wells were washed in PBST and serum added at a range of concentrations (1: 100-10,000) diluted in PBST+1% BSA. One and half hours post-serum addition, plates were washed and then incubated with a Donkey-anti Human IgG IgM HRP-conjuagted secondary antibody (Jackson) diluted at 1:10,000 in PBST for 1 hour at room temperature. Plates were then washed and bound secondary antibody detected using TBM (KPL). Plates were then read at 450 nm. To determine induction of an FLNB antibody response, the post-therapy O.D. value was divided by the pre-therapy O.D to determine a fold induction. Fold induction levels>2 were considered significant. In patients 1, 3, 4, and 5, a significant fold increase in O.D. could be observed by the post/pre ratio. In comparison IgG/IgM antibodies to tetanus toxoid, a protein to which the majority of the population has been actively vaccinated to, was unchanged (pre/post ration<2) following treatment indicating the increase in titer is FLNB specific. Results indicating patient antibody generation to FLNB following therapy agree for western blot and ELISA analysis (i.e. patients 1, 3, 4, and 5 were positive).

7.1.3.2 Cloning, Protein Production and Antibody Response to PNPO Following Immunotherapy PNPO was cloned with a C-terminus Flag tag into a lentivirus plasmid vector, using a PNPO clone identified from SEREX analysis to generate pKCCMVPNPOflag. PNPO-flag was cloned by PCR attaching the Flag tag to the 3'end of the gene using the forward primers (5'-gcctacccacaggagattcc) SEQ ID NO: 163 and the reverse primer (5'-gtaatctccggaag-gtgcaagtctctcataga) SEQ ID NO: 164 using a SEREX identified PNPO clone as s DNA PCR template. The PCR product was cleaned by Qiagen PCR purification kit, digested with Apa1 and BspE1, and ligated into identical sites in the parental vector pKCCMVp53flagdR1. The vector construct called pKCCMVPNPOflag was then sequence verified.

Flag-tagged PNPO was produced in mammalian cells and purified using affinity purification. In brief, twenty-four hours before transfection, 10 75 cm$^2$ plates were seeded with 5×10e6 cells/plate HEK293 cells. Twenty-four hours later, cells were transfected with 10 μg/plate of pKCCMVPNPOflag using a calcium phosphate transfection kit (Clontech). Three days post-transfection cells were lysed with cell lysis buffer (+protease inhibitors) and PNPO protein purified using Anti-Flag M2 affinity columns (Sigma) according to manufacturing instructions.

For western analysis of patients antibodies to PNPO, 150 ng of purified PNPO was separated on a Tris-Glycine gel (Invitrogen) under reducing conditions and transferred to a nitrocellulose membrane. Blots were then blocked overnight with 3% nonfat dry milk in TBS and incubated with a 1:500 dilution of patients serum post-therapy for 3 hours. Blots were then washed in TBST and incubated with an IgG/IgM specific donkey anti-human secondary antibody conjugated to horseradish peroxidase for an hour and a half. Following TBST washes immunoreactive bands were visualized by exposure of photographic film (Kodak) after the blots were treated with the ECL enhanced chemiluminescence system (Pierce). In samples from Patients 1, 2, 3, and 5, an immunoreactive band at 30 kDa running at the predicted molecular weight of PNPO could be observed in the post-therapy serum samples. Immunoreactivity was absent in pre-therapy samples.

96 well plates were coated with 250 ng/well of purified PNPO overnight in bicarbonate buffer (coating buffer). The next day, wells were washed with PBST and then blocked using 1% BSA in PBST for 3 hours at room temperature. Following blocking, wells were washed in PBST and serum added at a range of concentrations (1:100-10,000) diluted in PBST+1% BSA. One and half hours post-serum addition, plates were washed and then incubated with a Donkey-anti Human IgG IgM HRP-conjuagted secondary antibody (Jackson) diluted at 1:10,000 in PBST for 1 hour at room temperature. Plates were then washed and bound secondary antibody detected using TBM (KPL). Plates were then read at 450 nm. To determine induction of an PNPO antibody response, the post-therapy O.D. value was divided by the pre-therapy O.D.

to determine a fold induction. Fold induction levels>2 were considered significant. In patients 1, 2, 3 and 5, a significant fold increase in O.D. could be observed by the post/pre ratio. In comparison, IgG/IgM antibodies to tetanus toxoid, a protein against which the majority of the population has been actively vaccinated, were unchanged (pre/post ration<2) following treatment. This indicates that the increase in titer was PNPO specific. Results indicating patient antibody generation to PNPO following therapy agreed for western blot and ELISA analysis (i.e., patients 1, 2, 3 and 5 were positive for both assays).

7.1.3.3 Cloning, Protein Production and Antibody Response to NSFL1C

NSFL1C was cloned with a C-terminus Flag tag into a lentivirus vector, using a NSFL1C clone identified from SEREX analysis to generate pKCCMVNSFL1Cflag. pKCCMVNSFL1Cflag was cloned by PCR attaching the Flag tag to the 3'end of the NSFL1C gene and an ATG start codon to the 5'end of the gene. To generate this PCR product, the forward primer (5'-gggcccgaattcatggcggcggagcga-caggaggcgctg) SEQ ID NO: 165 and the reverse primer (5'-gtaatctccggatgttaaccgctgcacgatga) SEQ ID NO: 166 were used with the SEREX identified clone of NSFL1C as the DNA PCR template and High Fidelity Expand PCR kit. The PCR product was cleaned by Qiagen PCR Purification Kit, digested with EcoR1 and BspE1, and ligated into identical sites in the parental vector pKCCMVp53flagdR1. The resulting vector construct pKCCMVNSFL1Cflag was sequenced verified.

Flag-tagged NSFL1C was produced in mammalian cells and purified using affinity purification. In brief, twenty-four hours before transfection, 10 75 cm$^2$ plates were seeded with 5×10e6 cells/plate HEK293 cells. Twenty-four hours later, cells were transfected with 10 μg/plate of pKCCMVNSFL1Cflag using a calcium phosphate transfection kit (Clontech). Three days post-transfection cells were lysed with cell lysis buffer (+protease inhibitors) and NSFL1C protein purified using Anti-Flag M2 affinity columns (Sigma) according to manufacturing instructions.

For western analysis of patients antibodies to NSFL1C, 150 ng of purified NSFL1C was separated on a Tris-Glycine gel (Invitrogen) under reducing conditions and transferred to a nitrocellulose membrane. Blots were then blocked overnight with 3% nonfat dry milk in TBS and incubated with a 1:500 dilution of patients serum post-therapy for 3 hours. Blots were then washed in TBST and incubated with an IgG/IgM specific donkey anti-human secondary antibody conjugated to horseradish peroxidase for an hour and a half. Following TBST washes immunoreactive bands were visualized by exposure of photographic film (Kodak) after the blots were treated with the ECL enhanced chemiluminescence system (Pierce). In serum from patients 1, 3 and 4, an immunoreactive band at 40 kDa correlating with the expected size of NSFL1C could be observed in the post-therapy serum samples. Immunoreactivity was absent in pre-therapy samples.

ELISAs were also performed to assess immune response against NSFL1C. To do so, 96 well plates were coated with 250 ng/well of purified NSFL1C overnight in bicarbonate buffer (coating buffer). Next day, wells were washed with PBST and then blocked using 1% BSA in PBST for 3 hours at room temperature. Following blocking, wells were washed in PBST and serum added at a range of concentrations (1: 100-10,000) diluted in PBST+1% BSA. One and half hours post-serum addition, plates were washed and then incubated with a Donkey-anti Human IgG IgM HRP-conjuagted secondary antibody (Jackson) diluted at 1:10,000 in PBST for 1 hour at room temperature. Plates were then washed and bound secondary antibody detected using TBM (KPL). Plates were then read at 450 nm. To determine induction of a NSFL1C antibody response, the post-therapy O.D. value was divided by the pre-therapy O.D. to determine a fold induction. Fold induction levels>2 were considered significant. In patients 1, 3 and 4, a significant fold increase in O.D. to NSFL1C could be observed by the post/pre ratio. In comparison IgG/IgM antibodies to tetanus toxoid, a protein to which the majority of the population has been actively vaccinated to, was unchanged (pre/post ration<2) following treatment indicating the increase in titer is NSFL1C specific. Results indicating patient antibody generation to NSFL1C following treatment agree for western blot and ELISA analysis (i.e., patients 1, 3 and 4 were positive for both ELISA and western analysis).

7.1.4. Expression Levels of Genes

The role of some of the high-frequency hits in prostate cancer progression through examining RNA expression levels has been preliminarily examined. For example, FIGS. 1 and 2 present the expression patterns of PNPO and FLNB, respectively, with increasing prostate cancer disease grade derived from the Oncomine database (www.oncomine.com). Expression of both PNPO and FLNB are induced upon prostate cancer disease progression, tying in with their potential roles as tumor associated antigens. Expression of the closely related family member filamin A (ABP280), is selectively down-regulated with disease progression for comparison (Varambally et al. 2005).

7.2 Example 2

Defined Prostate Cancer Antigen Screening

This example describes the results of experiments designed to assess humoral immune responses against prostate cancer antigens. In these experiments, a selection of 20 genes that are associated with prostate cancer and have previously demonstrated an interaction with the immune response were selected for evaluation. The genes are set forth in Table 5, below. This list includes:

TABLE 5

Prostate specific antigen (PSA)
Prostate-specific membrane antigen (PSMA)
Prostatic acid phosphatase (PAP)
Prostate stem cell antigen (PSCA)
NY-ESO-1
LAGE
Telomerase (hTERT)
p53
Carcinoembryonic antigen (CEA)
Her2/neu
α-methylacyl-CoA racemase (AMACR)
Glucose-regulated protein-78 kDa (GRP78)
P62
P90
Cyclin-B1
TARP (T-cell receptor gamma alternate reading frame protein)
Filamin B (CGi identified)
Prostein
Survivin
Prostase/Kallikrein 4

All of these candidates were cloned into a plasmid expression system and recombinant proteins expressed using FLAG-tag based immunoaffinity purification. Following protein production, patient serum was assessed in both a western blot and/or in an ELISA format to immunoscreen candidates for antibody reactivity. Screening the patients from a monotherapy trial, 5 antigens associated with an autoantibody response were identified as set forth in Table 6, below.

TABLE 6

| Gene | Genbank accession number | Frequency of pre-existing, un-\augmented autoantibody response | Frequency of autoantibody induction |
|---|---|---|---|
| Filamin B, beta (FLNB) | NM_001457 | 0/7 | 4/7 |
| Prostate-specific membrane antigen (PSMA) | NM_004476 | 1/7 | 1/7 |
| Her2/neu | NM_004448 | 1/7 | 0/7 |
| NY-ESO-1 | HSU87459 | 0/7 | 1/6 |
| LAGE-1a | HSA223041 | 0/7 | 1/6 |

7.2.1. Cloning and Characterization of Antigens

Following identification of proteins correlated with an antibody response in serum, antigen targets are further characterized for cellular immune response (T-cells) using peripheral blood mononuclear cells (PBMCs) harvested from patients administered cell-based prostate cancer immunotherapy.

7.2.1.1 Detecting Activation of Cytotoxic T Lymphocytes in IFN-γ Assays

This example provides an exemplary method for detecting activation of cytotoxic T lymphocytes (CTLs) by monitoring IFN-γ expression by the CTLs in response to exposure to an appropriate antigen, e.g., a filamin-B peptide presented on an MHC I receptor.

First, peripheral blood monocytic cells (PBMCs) are isolated from a subject to be assessed for cellular immune response against a filamin-B peptide and CD8+ cells are isolated by fluorescence activated cell sorting (FACS). The CD8+ cells are then incubated with, e.g., T2 cells loaded with the filamin-B peptide to be assessed, produced as described above, and in the presence of suitable cytokines for expanding the CTL population.

IFN-γ release by the CTLs is measured using an IFN-γ ELISA kit (PBL-Biomedical Laboratory, Piscataway, N.J.). Briefly, purified IFN-γ as standards or culture supernates from the CTL-T2 co-culture are transferred into wells of a 96-well plate pre-coated with a monoclonal anti-human IFN-γ capture antibody and incubated for 1 h in a closed chamber at 24° C. After washing the plate with PBS/0.05% Tween 20, biotin anti-human IFN-γ antibody is added to the wells and incubated for 1 h at 24° C. The wells are washed and then developed by incubation with streptavidin horseradish peroxidase conjugate and TMB substrate solution. Stop solution is added to each well and the absorbance is determined at 450 nm with a SpectraMAX Plus plate reader (Stratagene, La Jolla, Calif.). The amount of cytokine present in the CTL culture supernatants is calculated based on the IFN-γ standard curve.

7.2.1.2 Detecting Activation of Cytotoxic T Lymphocytes in Proliferation Assays

This example provides an exemplary method for detecting activation of cytotoxic T lymphocytes (CTLs) by CTL proliferation in response to exposure to an appropriate antigen, e.g., a filamin-B peptide presented on an MHC I receptor.

First, peripheral blood monocytic cells (PBMCs) are isolated from a subject to be assessed for cellular immune response against a filamin-B peptide and CD8+ cells are isolated by fluorescence activated cell sorting (FACS). The CD8+ cells are then incubated with, e.g., T2 cells loaded with the filamin-B peptide to be assessed, produced as described above.

Next, the samples are incubated for 12 hours, then 20 µl of 3H-thymidine is added to each well and the sample incubated for an additional 12 hours. Cells are harvested and the plate is read in a beta counter to determine the amount of unincorporated 3H-thymidine.

7.2.1.3 Detecting Activation of Cytotoxic T Lymphocytes in Effector Assays

This example provides an exemplary method for detecting activation of cytotoxic T lymphocytes (CTLs) by monitoring lysis of cells displaying an appropriate antigen, e.g., a filamin-B peptide presented on an MHC I receptor.

The cytotoxic activity of the CTLs is measured in a standard $^{51}$Cr-release assay. Effector cells (CTLs) are seeded with $^{51}$Cr-labeled target cells ($5 \times 10^3$ cells/well) at various effector:target cell ratios in 96-well U-bottom microtiter plates. Plates are incubated for 4 h at 37° C., 5% $CO_2$. The $^{51}$Cr-release is measured in 100 µl supernatant using a Beckman LS6500 liquid scintillation counter (Beckman Coulter, Brea, CA). The percent specific cell lysis is calculated as [(experimental release–spontaneous release)/(maximum release–spontaneous release)]. Maximum release is obtained from detergent-released target cell counts and spontaneous release from target cell counts in the absence of effector cells.

7.3 Autoantibody Detection Following Therapy Using Protein Microarrays

In addition to SEREX and defined prostate tumor associated antigen screening, a third technique, autoantibody detection using protein microarrays, was employed to determine therapy-related increases in patient antibody titer following immunotherapy. Protein microarrays are new tools that provide investigators with defined protein content for profiling serum samples to identify autoantigen biomarkers (Casiano et al. 2006; Bradford et al. 2006; Qin et al. 2006). Invitrogen's ProtoArray® Human Protein Microarrays (version 4) contain over 8,000 purified human proteins immobilized on glass slides. Probing protein microarrays with serum from pre-therapy and post-therapy patient serum samples allows the identification of immunogenic proteins that are potential antigens.

7.3.1. Immune Response Biomarkers Identified by ProtoArray Analysis: Set 1

Immune Response Biomarker Profiling was performed by Invitrogen for seven serum samples: Pre-therapy and Post-therapy serum samples for 3 patients and 1 normal serum donor for comparison. The reactivity of serum antibodies against proteins on ProtoArray® Human Protein Microarrays was investigated. Comparisons were made across sera from three individual prostate cancer patients prior to and following treatment. For each patient, a number of proteins were identified exhibiting elevated signals (pixel intensity) in the post-treatment sample relative to the prostate cancer samples prior to therapy. While a number of markers were unique to the individual patients, several candidate autoantigens were identified that were shared between multiple patients included in the study. These included the proteins listed below:

TABLE 7

OUTB2
FLJ14668

TABLE 7-continued

HIGD2A
LOC51240
Neuronatin
CD52
ORM1-like 3
Mitogen-activated protein kinase kinase kinase 11
UBX domain containing 8

Protein array analysis indicated 2 of the 3 patients were positive for the protein OUTB2 (Swiss-prot Q96DC9). Patients displayed a 14.1 and 7.7-fold increase in titer, compared to a low signal background in normal serum samples.

Protein array analysis indicated 3 out of the 3 patients were positive for the protein product derived from FLJ14668 (NP_116211). Patients displayed a 36.2, 5.2 and 7.7-fold increase in titer, compared to a low signal background in the normal serum samples.

Protein array analysis indicated 3 out of the 3 patients were positive for the protein product of gene HIGD2A (NP_620175). Patients displayed a 3.5, 2.2 and 2.1-fold increase in antibody titer, compared to a low signal background in the normal serum samples.

Protein array analysis indicated 3 out of the 3 patients were positive for the protein product of gene LOC51240 (NP_054901). Patients displayed a 5.2, 4.7 and 6.4-fold increase in antibody titer, compared to a low signal background in the normal serum samples.

Protein array analysis indicated 3 out of the 3 patients were positive for the protein product of gene Neuronatin (NP_005377 (isoform A/NP_859017 (isoform B)). Patients displayed a 8.0, 2.3 and 2.6-fold increase in antibody titer, compared to a low signal background in the normal serum samples Protein array analysis indicated 3 out of the 3 patients were positive for the protein product of gene CD52 (NP_001794). Patients displayed a 4.1, 2.4 and 3.1-fold increase in antibody titer, compared to a low signal background in the normal serum samples.

Protein array analysis indicated 3 out of the 3 patients were positive for the protein product ORM1-like 3 (NP_644809) of gene ORMDL3. Patients displayed a 5.6, 1.7 and 2.5-fold increase in antibody titer, compared to a low signal background in the normal serum samples.

Protein array analysis indicated 3 out of the 3 patients were positive for the protein product Mitogen-activated protein kinase 11 (NP_002410) of gene MAP3K11. Patients displayed a 7.7, 1.7 and 3.0-fold increase in antibody titer, compared to a low signal background in the normal serum samples.

Protein array analysis indicated 3 out of the 3 patients were positive for the protein product UBX domain containing 8 (NP_055428) of gene UBXD8. Patients displayed a 5.9, 2.5 and 2.3-fold increase in antibody titer for 1 clone and 3.0, 1.8 and 1.6-fold increase for another clone, compared to a low signal background in the normal serum samples.

7.3.2. Immune Response Biomarkers Identified by ProtoArray Analysis: Set 2

Immune Response Biomarker Profiling was performed by Invitrogen for Pre-GVAX and Post-GVAX serum samples for 10 patients (8 patients from G-0010 and 2 from G-9803, described below). Patients were selected for ProtoArray analysis based upon their improved clinical outcome when comparing predicted survival (Halabi nomogram) to actual (Table 8).

TABLE 8

| GVAX Study | Patient # | Halabi score | Actual survival | Survival increase (Actual − Halabi) |
|---|---|---|---|---|
| G-0010 | 451 | 14 | 47.9 | 33.9 |
| G-0010 | 57 | 15 | 44.9 | 29.9+ |
| G-0010 | 202 | 21 | 52.2+ | 31.2+ |
| G-0010 | 101 | 25 | 43.9+ | 18.9+ |
| G-0010 | 355 | 24 | 35.5+ | 11.5+ |
| G-0010 | 306 | 18 | 36.2+ | 18.2+ |
| G-0010 | 205 | 24 | 48.3+ | 24.3+ |
| G-0010 | 268 | 21 | 41.5+ | 20.5+ |
| G-9803 | 804 | 22 | 38.5 | 16.5 |
| G-9803 | 304 | 19 | 42 | 23 |

+indicates that actual survival has not yet been reached

Comparisons were made across sera from 10 individual GVAX patients, and results were compared using M-Statistics to determine the differential signals between pre and post-GVAX populations that result in a significant P-value. Proteins that exhibited a significant increase in antibody titer (p=<0.05), as determined by ProtoArray, are displayed in Table 9.

TABLE 9

| Protein Description | Database ID | Pre-GVAX Count | Post-GVAX Count | Pre-GVAX Prevalence | Post-GVAX Prevalence | P-Value |
|---|---|---|---|---|---|---|
| lectin, galactoside-binding, soluble, 8 (galectin 8) (LGALS8) | BC015818.1 | 0 | 9 | 8.3% | 83.3% | 5.95E−05 |
| Cardiolipin - known Autoantigen | CARDIOLIPIN | 1 | 9 | 16.7% | 83.3% | 5.47E−04 |
| UBX domain containing 8 (UBXD8) | BC014001.1 | 0 | 7 | 8.3% | 66.7% | 1.55E−03 |
| CD52 molecule | NM_001803.1 | 0 | 7 | 8.3% | 66.7% | 1.55E−03 |
| ORM1-like 1 (S. cerevisiae) (ORMDL1) | NM_016467.1 | 1 | 10 | 16.7% | 91.7% | 1.55E−03 |
| neuronatin (NNAT) | NM_181689.1 | 2 | 9 | 25% | 83.3% | 2.74E−03 |
| TCR gamma alternate reading frame protein (TARP), nuclear gene encoding mitochondrial protein | NM_001003799.1 | 3 | 10 | 33.3% | 91.7% | 5.42E−03 |
| HIG 1 domain family, member 2A (HIGD2A) | NM_138820.1 | 3 | 10 | 33.3% | 91.7% | 5.42E−03 |
| serine incorporator 2 (SERINC2) | BC017085.1 | 0 | 6 | 8.3% | 58.3% | 5.42E−03 |

TABLE 9-continued

| Protein Description | Database ID | Pre-GVAX Count | Post-GVAX Count | Pre-GVAX Prevalence | Post-GVAX Prevalence | P-Value |
|---|---|---|---|---|---|---|
| signal sequence receptor, gamma (translocon-associated protein gamma) (SSR3) | NM_007107.2 | 0 | 6 | 8.3% | 58.3% | 5.42E−03 |
| UBX domain containing 8 (UBXD8) | NM_014613.1 | 0 | 6 | 8.3% | 58.3% | 5.42E−03 |
| ORM1-like 3 (S. cerevisiae) (ORMDL3) | NM_139280.1 | 1 | 7 | 16.7% | 66.7% | 9.88E−03 |
| ribosomal protein S6 kinase, 90 kDa, polypeptide 2 (RPS6KA2) | PV3846 | 1 | 7 | 16.7% | 66.7% | 9.88E−03 |
| lectin, galactoside-binding, soluble, 3 (LGALS3) | BC001120.1 | 4 | 10 | 41.7% | 91.7% | 1.63E−02 |
| selenoprotein S (SELS) | BC005840.2 | 0 | 5 | 8.3% | 50% | 1.63E−02 |
| lectin, galactoside-binding, soluble, 8 (galectin 8) (LGALS8) | BC016486.1 | 0 | 5 | 8.3% | 50% | 1.63E−02 |
| chromosome 14 open reading frame 147 | BC021701.1 | 0 | 5 | 8.3% | 50% | 1.63E−02 |
| similar to CG10671-like (LOC161247) | BC042179.1 | 0 | 5 | 8.3% | 50% | 1.63E−02 |
| lectin, galactoside-binding, soluble, 3 (LGALS3) | BC053667.1 | 4 | 10 | 41.7% | 91.7% | 1.63E−02 |
| caveolin 3 (CAV3) | NM_001234.3 | 0 | 5 | 8.3% | 50% | 1.63E−02 |
| cytochrome b-561 domain containing 2 (CYB561D2) | NM_007022.1 | 0 | 5 | 8.3% | 50% | 1.63E−02 |
| ORM1-like 2 (S. cerevisiae) (ORMDL2) | NM_014182.2 | 0 | 5 | 8.3% | 50% | 1.63E−02 |
| signal peptidase complex subunit 1 homolog (S. cerevisiae) (SPCS1) | BC000884.1 | 1 | 6 | 16.7% | 58.3% | 2.86E−02 |
| hypothetical protein FLJ14668 | BC014975.1 | 1 | 6 | 16.7% | 58.3% | 2.86E−02 |
| chromosome 21 open reading frame 51 (C21orf51) | BC015596.1 | 1 | 6 | 16.7% | 58.3% | 2.86E−02 |
| kelch domain containing 7B (KLHDC7B) | NM_138433.2 | 0 | 6 | 8.3% | 58.3% | 2.86E−02 |
| presenilin enhancer 2 homolog (C. elegans) (PSENEN) | NM_172341.1 | 1 | 6 | 16.7% | 58.3% | 2.86E−02 |
| stearoyl-CoA desaturase (delta-9-desaturase) (SCD) | BC005807.2 | 3 | 8 | 33.3% | 75% | 3.49E−02 |
| interferon regulatory factor 2 (IRF2) | BC015803.1 | 0 | 4 | 8.3% | 41.7% | 4.33E−02 |
| TNF receptor-associated protein 1 (TRAP1) | BC018950.2 | 0 | 4 | 8.3% | 41.7% | 4.33E−02 |
| N-glycanase 1 (NGLY1) | NM_018297.2 | 0 | 4 | 8.3% | 41.7% | 4.33E−02 |
| Der1-like domain family, member 1 (DERL1) | NM_024295.1 | 0 | 4 | 8.3% | 41.7% | 4.33E−02 |
| hippocampus abundant gene transcript-like 2 (HIATL2) | NM_032318.1 | 0 | 4 | 8.3% | 41.7% | 4.33E−02 |
| bridging integrator 1 (BIN1) | NM_139348.1 | 0 | 4 | 8.3% | 41.7% | 4.33E−02 |
| similar to RIKEN cDNA 1700029I15 (LOC143678) | XM_096472.2 | 0 | 4 | 8.3% | 41.7% | 4.33E−02 |

7.4 Association of SEREX and Protoarray Antigen Responses with Clinical Response in G-9803 and G-0010 GVAX Immunotherapy Trials for Prostate Cancer G-9803 (n=55 patients) and G-0010 (n=80 patients) are Phase II GVAX immunotherapy trials in chemotherapy-naïve patients with hormone-refractory prostate cancer (HRPC; FIGS. 3A and 3B).

The G-9803 study (FIG. 3A) included 2 different HRPC patient populations and 2 dose levels. In relation to HRPC patient populations, G-9803 enrolled PSA-rising and metastatic patients. Patients in the PSA-only group had increasing PSA levels but negative bone scan. Patients in the metastatic group had overt metastatic disease (positive bone scan, bidimensionally measurable disease, or both). All patients received a priming dose of $500 \times 10^6$ ($250 \times 10^6$ cells from each of PC3 and LNCaP cell lines). Patients in the PSA-only group and the first 24 patients in the metastatic group received the low dose (LD) boost of 100 million cells (50 million of each cell line). Since no dose limiting toxicities were seen at this dose level, a high dose (HD) of 300×10⁶ cells (150×10⁶ of each cell line) was given to 10 additional patients in the metastatic group. Each cell type was injected intradermally in opposite limbs every 2 weeks for 6 months.

The G-0010 study enrolled metastatic HRPC patients only (FIG. 3B). The G-0010 study included 4 dose levels:

Dose Level 1: Each vaccination consisted of 2 intradermal injections of PC-3 cells to deliver a total of 50×10⁶ cells, and 2 intradermal injections of LNCaP cells to deliver 50×10⁶ cells, for a total of 100×10⁶ cells per dose.

Dose Level 2: Each vaccination consisted of 3 intradermal injections of PC-3 cells to deliver a total of 100×10⁶ cells, and 3 intradermal injections of LNCaP cells to deliver 100×10⁶ cells, for a total of 200×10⁶ cells per dose.

Dose Level 3: Each vaccination consisted of up to 6 intradermal injections of PC-3 cells to deliver 150×10⁶ cells, and up to 6 intradermal injections of LNCaP cells to deliver 150×10⁶ cells, for a total of 300×10⁶ cells per dose.

Dose Level 4: The prime vaccination consisted of up to 10 intradermal injections of PC-3 cells to deliver 250×10⁶ cells, and up to 10 intradermal injections of LNCaP cells to deliver 250×10⁶ cells, for a total of 500×10⁶ cells per dose. The boost vaccinations consisted of up to 6 intradermal injections of PC-3 cells to deliver 150×10⁶ cells, and up to 6 intradermal injections of LNCaP cells to deliver 150×10⁶ cells, for a total of 300×10⁶ cells per dose.

The association between the induction of SEREX and ProtoArray identified antibodies with G98-03 and G-0010 patient survival using Kaplan-Meyer endpoint analysis was determined. As means of example, results for HLA-A24, OUTB2, FLJ14668, NNAT and Cardiolipin are presented.

7.4.1. Association of HLA-A24 Ab Response to Survival in GVAX-Treated Prostate Patients from the G-0010 Trial 7.4.1.1 Cloning Strategy for HLA-A24

HLA-A24 was cloned with a C-terminus Flag tag into a lentivirus plasmid vector, using a purchased HLA-A2402 plasmid clone (International Histocompatability Working Group) to generate pKCCMVHLA-A24Flag (FIG. 4A). Briefly, HLA-A2402Flag was cloned by PCR attaching the Flag tag to the 3'end of the gene using the forward primers (5'-atatggatccatggccgtcatggcgccccg) SEQ ID NO: 167 and the reverse primer (5'-aatctccggacactttacaagctgtgagag) SEQ ID NO: 168 using the HLA-A2402 plasmid clone as s DNA PCR template. The PCR product was cleaned by Roche gel extraction kit, digested with BamHI and BspE1, and ligated into identical sites in the parental vector pKCCMVNYESO1flag. The vector construct called pKCCMVHLA-A2402Flag has been sequenced verified. SEQ ID NOS. 155 and 156 represent the HLA-A2402Flag amino acid and nucleotide sequence, respectively.

7.4.1.2 HLA-A2402Flag protein production

Flag-tagged HLA-A24 was produced in mammalian cells and purified using affinity purification. In brief, twenty-four hours before transfection, 10 75 cm² plates were seeded with 5×10e6 cells/plate HEK293 cells. Twenty-four hours later, cells were transfected with 10 µg/plate of pKCCMVHLA-A2402Flag using a calcium phosphate transfection kit (Clontech). Three days post-transfection cells were lysed with cell lysis buffer (+protease inhibitors) and HLA-A2402Flag protein purified using Anti-Flag M2 affinity columns (Sigma) according to manufacturing instructions.

7.4.1.3 Analysis of GVAX-Treated Patient Antibodies to HLA-A24 Using Western Blot For western analysis of patients antibodies to HLA-A24, 200 ng of purified HLA-A24 was separated on a Tris-Glycine gel (Invitrogen) under reducing conditions and transferred to a nitrocellulose membrane. Blots were then blocked overnight with 3% nonfat dry milk in TBS and incubated with a 1:500 dilution of G-0010 patients (n=65) serum post-GVAX therapy for 3 hours. Blots were then washed in TBST and incubated with an IgG/IgM specific donkey anti-human secondary antibody conjugated to horseradish peroxidase for an hour and a half. Following TBST washes immunoreactive bands were visualized by exposure of photographic film (Kodak) after the blots were treated with the ECL enhanced chemiluminescence system (Pierce). As shown in FIG. 4B, in patients 104, 302, 307 and 437 an immunoreactive band at 45 kDa running at the predicted molecular weight of HLA-A24Flag could be observed in the post-GVAX serum samples. Immunoreactivity to additional HLA-A alleles (produced as for HLA-A24) present in the GVAX immunotherapy for prostate cancer (HLA-A 1 and A2) was only observed in 1 patient of 65 tested, patient 437. Immunostaining with an HRP-linked anti-FLAG monoclonal antibody demonstrates equal loading of all HLA-A proteins. Immunoreactivity was absent in pre-GVAX therapy samples (data not shown). Twenty-five HRPC patients who received a full course (9 cycles) of Docetaxel (taxotere) chemotherapy were also evaluated for HLA-A24 immunoreactivity over the course of treatment (pre- and post-taxotere) by western blot analysis. No patient induced a response over the course of therapy indicating the specificity of HLA-A24 antibody induction to GVAX immunotherapy for prostate cancer treated patients.

7.4.1.4 Association of HLA-A24 Immune Response and Survival

The association of HLA-A24 Ab response with survival was examined in the patients from the phase 2 G-0010 GVAX immunotherapy for prostate cancer trial. Patients were scored HLA-A24 antibody positive or negative dependent on western blot immunoreactivity and the potential association with survival analyzed using the Cox regression model, adjusted for prognostic factors and dose group (FIG. 4C). Data from all evaluable G-0010 pts demonstrate that induction of Ab to the PC-3-derived HLA-A24 is associated with survival. Among HLA-A24 haplotype negative pts, the HLA-A24 Ab-positive pts (n=30) had a median survival of 43 m vs. 18 m in Ab-negative pts (n=28), HR=0.53, p=0.04. Indicating a 47% reduction in hazard rate (HR) in those patients with HLA-A24 antibodies compared to those without antibodies, after controlling for the Halabi predicted survival.

7.4.2. Association of OUTB2 Ab Response to Survival in HRPC Patients Treated with GVAX Immunotherapy for Prostate Cancer Employing an ELISA based-assay for determining antibody titers, patients from G-9803 and G-0010 were evaluated for OUTB2 antibody titer induction post-GVAX immunotherapy. Purified OUTB2 protein (200 ng) was coated onto an ELISA plate and blocked with Superblock buffer for 2 hours. Patient serum both pre and post-GVAX immunotherapy was then added to the plates for 3 hours at room temperature. Following incubation, bound antibody was detected using a Donkey anti-human IgG-HRP conjugate secondary antibody at 1:10,000 dilution. Induced antibody titers to OUTB2 were determined by dividing the well O.D. of the post-GVAX sample with the pre-GVAX O.D. to provide a fold-induction. Patients with a fold induction≧2 fold, were considered positive for the survival analysis. An example of OUTB2 antibody induction in G-0010 patients is shown in FIG. 5A. Survival of those patients with induced Ab responses to OUTB2 were then compared to OUTB2 negative patients in G-0010 and G-9803. A survival advantage was observed in both trials. A representative survival analysis is shown in G-9803 PSA-rising HRPC patients. As shown in FIG. 5B, induction of antibodies to OUTB2 is associated with a 26.7 months longer survival in G-9803 patients. The correlation with survival in the PSA-rising population of G-9803 is also statistically significant (p=0.0266).

7.4.3. Association of FLJ14668 Ab Response to Survival in GVAX-Treated Prostate Patients from the G-0010 Trial 7.4.3.1 Cloning Strategy for FLJ14668

FLJ14668 was cloned with a C-terminus Flag tag into a lentivirus plasmid vector, using a purchased synthetically constructed FLJ14468Flag plasmid clone (GeneArt) to generate pKCCMV-FLJ14668Flag (FIG. 6A). Briefly, the FLJ14668Flag transgene was excised from the parental plasmid using EcoRI and SalI restriction enzymes and ligated into identical sites in the parental vector pKCCMVp53flagdR1. The resulting vector construct, pKCCMV-FLJ14668Flag, was sequenced verified. SEQ ID NOS. 157 and 158 represent the FLJ14668Flag amino acid and nucleotide sequence, respectively.

7.4.3.2 FLJ14668Flag Protein Production

Flag-tagged FLJ14668 was produced in mammalian cells and purified using affinity purification. In brief, twenty-four hours before transfection, 10 75 cm$^2$ plates were seeded with 5×10e6 cells/plate HEK293 cells. Twenty-four hours later, cells were transfected with 10 µg/plate of pKCCMV-FLJ14668Flag using a calcium phosphate transfection kit (Clontech). Three days post-transfection cells were lysed with cell lysis buffer (+protease inhibitors) and FLJ14668Flag protein purified using Anti-Flag M2 affinity columns (Sigma) according to manufacturing instructions.

7.4.3.3 Analysis of GVAX-Treated Patient Antibodies to FLJ14668 Using ELISA 96 well plates were coated with 250 ng/well of purified FLJ14668 overnight in bicarbonate buffer (coating buffer). Next day, wells were washed with PBST and then blocked using 1% BSA in PBST for 3 hours at room temperature. Following blocking, wells were washed in PBST and serum added at a 1:100 dilution in PBST+1% BSA. One and half hours post-serum addition, plates were washed and then incubated with a Donkey-anti Human IgG IgM HRP-conjuagted secondary antibody (Jackson) diluted at 1:10,000 in PBST for 1 hour at room temperature. Plates were then washed and bound secondary antibody detected using TBM (KPL). Plates were then read at 450 nm. To determine induction of an FLJ14668 antibody response, the post-GVAX O.D value was divided by the pre-GVAX O.D to determine a fold induction (FIG. 6B). Fold induction levels>2 were considered significant (as determined by normal controls). In comparison IgG/IgM antibodies to tetanus toxoid, a protein to which the majority of the population has been actively vaccinated to, was unchanged (pre/post ration<2) following GVAX-treatment indicating the increase in titer specific to FLJ14668 (FIG. 6C). Twenty-five HRPC patients who received a full course (9 cycles) of Docetaxel (taxotere) chemotherapy were also evaluated for FLJ14668 immunoreactivity over the course of treatment (pre- and post-taxotere) by ELISA. No patient induced a response over the course of therapy indicating the specificity of FLJ14668 antibody induction to GVAX immunotherapy for prostate cancer treated patients.

7.4.3.4 Association of FLJ14668Flag Immune Response and Survival in G-0010

The association of FLJ14668 Ab response with survival was examined in the patients from the phase 2 G-0010 GVAX immunotherapy for prostate cancer trial. Patients were scored FLJ14668 antibody positive or negative dependent on a fold induction of antibody titer>2 fold and the potential association with survival analyzed using the Cox regression model, adjusted for prognostic factors and dose group (FIG. 6D). Data from all evaluable G-0010 pts demonstrate that induction of Ab to the FLJ14668 is significantly associated with survival. Patients with an induction of antibody response to FLJ14668 protein (n=34) had a median survival of 43 m vs. 21 m in antibody negative pts (n=31), p=0.002.

The patients with FLJ14668 antibody had 66% reduction in hazard rate (HR), compared to those patients antibody negative. Patient survival in FLJ14668 antibody positive and negative arms was also compared to predicted survival (as determined by the Halabi nomogram) in G-0010 by dose level (FIG. 6E). Results indicate that in all 3 G-0010 dose groups that survival was significantly increased over predicted in FLJ14668 seroconverters compared to those patients were an increase in FLJ14668 titer was not observed. Furthermore, the proportion of patients FLJ14668 antibody positive was dose-responsive comparing low, mid and high G-0010 dose groups (FIG. 6F).

7.4.4. Association of Neuronatin (NNAT) Ab Response to Survival in GVAX-Treated Prostate Patients from the G-0010 Trial 7.4.4.1 Cloning strategy for NNAT NNAT was cloned with a C-terminus Flag tag into a lentivirus plasmid vector, using a purchased synthetically constructed NNATFlag plasmid clone (GeneArt) to generate pKCCMV-NNATFlag (FIG. 7A). Briefly, the NNATFlag transgene was excised from the parental plasmid using EcoRI and SalI restriction enzymes and ligated into identical sites in the parental vector pKCCMVp53flagdR1. The resulting vector construct, pKCCMV-NNATFlag, was sequenced verified. SEQ ID NOS. 159 and 160 represent the NNATFlag amino acid and nucleotide sequence, respectively.

7.4.4.2 NNATFlag Protein Production

Flag-tagged NNAT was produced in mammalian cells and purified using affinity purification. In brief, twenty-four hours before transfection, 10 75 cm$^2$ plates were seeded with 5×10e6 cells/plate HEK293 cells. Twenty-four hours later, cells were transfected with 10 µg/plate of pKCCMV-NNAT-Flag using a calcium phosphate transfection kit (Clontech). Three days post-transfection cells were lysed with cell lysis buffer (+protease inhibitors) and NNATflag protein purified using Anti-Flag M2 affinity columns (Sigma) according to manufacturing instructions.

7.4.4.3 Analysis of GVAX-Treated Patient Antibodies to NNAT Using ELISA 96 well plates were coated with 400 ng/well of purified NNAT overnight in bicarbonate buffer (coating buffer). Next day, wells were washed with PBST and then blocked using 1% BSA in PBST for 3 hours at room temperature. Following blocking, wells were washed in PBST and serum added at a 1:100 dilution in PBST+1% BSA. One and half hours post-serum addition, plates were washed and then incubated with a Donkey-anti Human IgG IgM HRP-conjuagted secondary antibody (Jackson) diluted at 1:10,000 in PBST for 1 hour at room temperature. Plates were then washed and bound secondary antibody detected using TBM (KPL). Plates were then read at 450 nm. To determine induction of an NNAT antibody response, the post-GVAX O.D value was divided by the pre-GVAX O.D to determine a fold induction (FIG. 7B). Fold induction levels>2 were considered significant (as determined by normal controls). Twenty-five HRPC patients who received a full course (9 cycles) of Docetaxel (taxotere) chemotherapy were also evaluated for NNAT immunoreactivity over the course of treatment (pre- and post-taxotere) by ELISA. No patient induced a response over the course of therapy indicating the specificity of NNAT antibody induction to GVAX immunotherapy for prostate cancer treated patients.

7.4.4.4 Association of NNATFlag Immune Response and Survival in G-0010

The association of NNAT Ab response with survival was examined in the patients from the phase 2 G-0010 GVAX immunotherapy for prostate cancer trial. Patients were scored NNAT antibody positive or negative dependent on a fold induction of antibody titer>2 fold and the potential association with survival analyzed using the Cox regression model, adjusted for prognostic factors and dose group (FIG. 7C). Data from all evaluable G-0010 pts demonstrate that induction of Ab to the NNAT is significantly associated with survival. Patients with an induction of antibody response to NNAT protein (n=48) had a median survival of 34 m vs. 10 m in antibody negative pts (n=17), p=<0.001.

The patients with NNAT antibody had 69% reduction in hazard rate (HR), compared to those patients antibody negative.

7.4.5. Antibody Response to Cardiolipin in GVAX-Treated Prostate Patients from the G-0010 Trial 7.4.5.1 Analysis of GVAX-Treated Patient Antibodies to Cardiolipin Using ELISA The induction of antibodies to cardiolipin were evaluated using a commercial kit (BioQuant). Briefly, patients serum diluted at 1:100 in PBST was added to wells coated with purified cardiolipin antigen. One and half hours post-serum addition, plates were washed 3×PBST and then incubated with enzyme-conjugated secondary antibody for 1 hour at room temperature. Plates were then washed and bound secondary antibody detected using TBM. Plates were then read at 450 nm. To determine induction of an cardiolipin antibody response, the post-GVAX O.D value was divided by the pre-GVAX O.D to determine a fold induction (FIG. 8A). Fold induction levels>2 were considered significant (as determined by normal controls). Twenty-five HRPC patients who received a full course (9 cycles) of Docetaxel (taxotere) chemotherapy were also evaluated for an increase in Cardiolipin antibody titer over the course of treatment (pre- and post-taxotere) by ELISA. No patient induced a response over the course of therapy indicating the specificity of Cardiolipin antibody induction to GVAX immunotherapy for prostate cancer treated patients.

7.4.5.2 Association of NNATFlag Immune Response and Survival in G-0010

The association of Cardiolipin Ab response with survival was examined in the patients from the phase 2 G-0010 GVAX immunotherapy for prostate cancer trial. Patients were scored Cardiolipin antibody positive or negative dependent on a fold induction of antibody titer>2 fold and the potential association with survival analyzed using the Cox regression model, adjusted for prognostic factors and dose group (FIG. 8B). Data from all evaluable G-0010 pts demonstrate that induction of Ab to the Cardiolipin is significantly associated with survival. Patients with an induction of antibody response to Cardiolipin protein (n=40) had a median survival of 38 m vs. 15 m in antibody negative pts (n=24), p=0.03. The patients with an increase in Cardiolipin antibody titer had 53% reduction in hazard rate (HR), compared to those no increase.

7.4.6. Antibody Response to HLA-A24 and/or FLJ14668 in GVAX-Treated Prostate Patients from the G-0010 Trial In addition to single antigen/antibody analysis with survival, it is also possible to group antigens together to further define the association of immune response with clinical response. FIG. 9 demonstrates the association of being HLA-A24 and/or FLJ14668 antibody positive with survival in G-0010 patients. Patients with an induction of antibody response to HLA-A24 and/or FLJ14668 (n=41) had a median survival of 43.5 m vs. 14.2 m in patients negative for antibodies to both antigens (n=24), p=<0.001. The patients with antibodies to either antigen had a 55% reduction in hazard rate (HR), compared to those patients antibody negative for both antigens.

7.4.7. Antibody Response to HLA-A24 and/or FLJ14668 in GVAX-Treated Prostate Patients from the G-0010 Trial In addition to single antigen/antibody analysis with survival, it is also possible to group antigens together to further define the association of immune response with clinical response. FIG. 10 demonstrates the association of being HLA-A24 and/or FLJ14668 antibody positive with survival in G-0010 patients. Patients with an induction of antibody response to HLA-A24 and/or FLJ14668 (n=41) had a median survival of 43.5 m vs. 14.2 m in patients negative for antibodies to both antigens (n=24), p=<0.001. The patients with antibodies to either antigen had a 55% reduction in hazard rate (HR), compared to those patients antibody negative for both antigens.

7.4.8. Antibody Response to FLJ14668 and/or HLA-A24 and/or Cardiolipin in GVAX-Treated Prostate Patients from the G-0010 Trial In addition to single and double antibody analysis with survival, it is also possible to group three antigens together to further define the association of immune response with clinical response. FIG. 11 demonstrates the association of being FLJ14668 and/or HLA-A24 and/or Cardiolipin antibody positive with survival in G-0010 patients. Patients with an induction of antibody response to FLJ14668 and/or HLA-A24 and/or Cardiolipin (n=47) had a median survival of 34.8 m vs. 11.4 m in patients negative for antibodies to all three antigens (n=19), p=<0.0001. The patients with antibodies to either antigen had a 68% reduction in hazard rate (HR), compared to those patients antibody negative for all three antigens.

7.4.9. A Combination of HLA-A24 and OUTB2 Antibody Responses Provide a Correlation with Patient Survival Across Multiple GVAX Immunotherapy for Prostate Cancer Trials (G-0010 and G-9803)

Antibody responses to HLA-A24 and OUTB2 were then grouped together, given their correlation with survival as single antigens, to observe their ability to predict clinical outcome in G-0010 and G-9803 as a combination. The survival of patients who were OUTB2 and/or HLA-A24 antibody induction positive was compared to those patients negative for both responses. As shown in FIGS. 12A-12C, induction of antibodies to HLA-A24 and/or OUTB2 is associated with a statistically longer survival time in G-9803 metastatic HRPC patients (18 months increase in MST, p=0.0107, FIG. 12A), G-9803 PSA-rising HRPC patients (27.3 months increase in MST, p=0.0103, FIG. 12B) and G-0010 metastatic HRPC patients (20.1 months increase in MST, p<0.0001, FIG. 12C).

7.4.10. The Induction of HLA-A24, OUTB2 or FLJ14668 Immunoreactivity is Dose and Treatment Number Dependent in G-9803 and G-0010

We examined the impact of GVAX immunotherapy dose level in the G-0010 trial with the frequency of antibody responses to HLA-A24, OUTB2 and FLJ14668 (FIG. 13A). For all antigens examined, there was a step wise increase in the percentage of responding patients with increasing dose-level. The average number of treatments received in the antibody positive versus antibody negative arms of the G-0010 study were also compared for HLA-A24, OUTB2 and FLJ14668 (FIG. 13B-13d). On average antibody-negative patients received 5.93, 5.6, 5.16 treatments for HLA-A24, OUTB2 and FLJ14668, respectively. In comparison, patients with an induced antibody response received 9.23, 9.62 and 9.44 treatments for HLA-A24, OUTB2 and FLJ14668, respectively (p<0.01 for all antigens).

REFERENCES

Casiano C A, Mediavilla-Varela M, Tan E M. Tumor-associated antigen arrays for the serological diagnosis of cancer. Mol Cell Proteomics. 2006 October; 5(10):1745-59. Epub 2006 May 29. Review. PMID: 16733262.

Bradford T J, Wang X, Chinnaiyan A M. Cancer immunomics: using autoantibody signatures in the early detection of prostate cancer. Urol Oncol. 2006 May-June; 24(3):237-42. PMID: 16678056.

Qin S, Qiu W, Ehrlich J R, Ferdinand A S, Richie J P, O'leary M P, Lee M L, Liu B C. Development of a "reverse capture" autoantibody microarray for studies of antigen-autoantibody profiling. Proteomics. 2006 Apr. 5;

Wang X, Yu J, Sreekumar A, Varambally S, Shen R, Giacherio D, Mehra R, Montie J E, Pienta K J, Sanda M G, Kantoff P W, Rubin M A, Wei J T, Ghosh D, Chinnaiyan A M. Autoantibody signatures in prostate cancer. N Engl J Med 2005 Sep. 22; 353(12): 1224-35.

Dunphy E J, McNeel D G. Antigen-specific IgG elicited in subjects with prostate cancer treated with flt3 ligand. J Immunother. 2005 May-June; 28(3):268-75.

McNeel D G, Nguyen L D, Storer B E, Vessella R, Lange P H, Disis M L. Antibody immunity to prostate cancer associated antigens can be detected in the serum of patients with prostate cancer. J Urol. 2000 November; 164(5):1825-9.

Sahin U, Tureci O, Schmitt H, Cochlovius B, Johannes T, Schmits R, Stenner F, Luo G, Schobert I, Pfreundschuh M. Human neoplasms elicit multiple specific immune responses in the autologous host. Proc Natl Acad Sci USA. 1995 Dec. 5; 92(25):11810-3.

Varambally S, Yu J, Laxman B, Rhodes D R, Mehra R, Tomlins S A, Shah R B, Chandran U, Monzon F A, Becich M J, Wei J T, Pienta K J, Ghosh D, Rubin M A, Chinnaiyan A M. Integrative genomic and proteomic analysis of prostate cancer reveals signatures of metastatic progression. Cancer Cell. 2005 November; 8(5):393-406.

Halabi, et al. Prognostic model for predicting survival in men with HRPC: Journal of Clinical Oncology, 2003; 21(7): 1232-7

While many specific examples have been provided, the above description is intended to illustrate rather than limit the invention. Many variations of the invention will become apparent to those skilled in the art upon review of this specification. The scope of the invention should, therefore, be determined not with reference to the above description, but instead should be determined with reference to the appended claims along with their full scope of equivalents.

All sequences referenced by accession number, publications, and patent documents cited in this application are incorporated by reference in their entirety for all purposes to the same extent as if each individual publication or patent document were so individually denoted. Citation of these documents is not an admission that any particular reference is "prior art" to this invention.

SEQUENCE LISTING (168 sequences)

SEQ ID NO: 1 - protein, 365 aa, Homosapien [sequence omitted]

SEQ ID NO: 2 - DNA, 1095 bp, Homosapien
atggccgtcatggcgccccgaaccctcgtcctgctactctcgggggccctggccctgacccagacctgggcaggctcccactccatgaggtatttctccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacgaggagacagggaaagtgaaggcccactcacagactgaccgagagaacctgcggatcgcgctccgctactacaaccagagcgaggccggttctcacaccctccagatgatgtttggctgcgacgtggggtcggacgggcgcttcctccgcgggtaccaccagtacgcctacgacggcaaggattacatcgccctgaaagaggacctgcgctcttggaccgcggcggacatggcggctcagatcaccaagcgcaagtgggaggcggcccatgtggcggagcagcagagagcctacctggagggcacgtgcgtggacgggctccgcagatacctggagaacgggaaggagacgctgcagcgcacggacccccccaagacacatatgacccaccaccccatctctgaccatgaggccactctgagatgctgggccctgggcttctaccctgcggagatcacactgacctggcagcgggatggggaggaccagacccaggacacggagcttgtggagaccaggcctgcaggggatggaaccttccagaagtgggcagctgtggtggtaccttctggagaggagcagagatacacctgccatgtgcagcatgagggtctgcccaagcccctcaccctgagatgggagccatcttcccagcccaccgtccccatcgtgggcatcattgctggcctggttctccttggagctgtgatcactggagctgtggtcgctgctgtgatgtggaggaggaacagctcagatagaaaaggagggagctactctcaggctgcaagcagtgacagtgcccagggctctgatgtgtctctcacagcttgtaaagtg

SEQ ID NO: 3 - protein, 2602 aa, Homosapien
MPVTEKDLAEDAPWKKIQQNTFTRWCNEHLKCVNKRIGNLQTDLSDGLRLIALLEVLSQKRMYRKYHQRPTFRQMQLENVSVALEFLDRESIKLVSIDSKAIVDGNLKLILGLVWTLILHYSISMPVWEDEGDDDAKKQTPKQRLLGWIQNKIPYLPITNFNQNWQDGKALGALVDSCAPGLCPDWESWDPQKPVDNAREAMQQADDWLGVPQVITPEEIIHPDVDEHSVMTYLSQFPKAKLKPGAPLKPKLNPKKARAYGRGIEPTGNMVKQPAKFTVDTISAGQGDVMVFVEDPEGNKEEAQVTPDSDKNKTYSVEYLPKVTGLHKVTVLFAGQHISKSPFEVSVDKAQGDASKVTAKGPGLEAVGNIANKPTYFDIYTAGAGVGDIGVEVEDPQGKNTVELLVEDKGNQVYRCVYKPMQPGPHVVKIFFAGDTIPKSPFVVQVGEACNPNACRASGRGLQPKGVRIRETTDFKVDTKAAGSGELGVTMKGPKGLEELVKQKDFLDGVYAFEYYPSTPGRYSIAITWGGHHIPKSPFEVQVGPEAGMQKVRAWGPGLHGGIVGRSADFVVESIGSEVGSLGFAIEGPSQAKIEYNDQNDGSCDVKYWPKEPGEYAVHIMCDDEDIKDSPYMAFIHPATGGYNPDLVRAYGPGLEKSGCIVNNLAEFTVDPKDAGKAPLKIFAQDGEGQRIDIQMKNRMDGTYACSYTPVKAIKHTIAVVWGGVNIPHSPYRVNIGQGSHPQKVKVFGPGVERSGLKANEPTHFTVDCTEAGEGDVSVGIKCDARVLSEDEEDVDFDIIHNANDTFTVKYVPPAAGRYTIKVLFASQEIPASPFRVKVDPSHDASKVKAEGPGLSKAGVENGKPTHFTVYTKGAGKAPLNVQFNSPLPGDAVKDLDIIDNYDYSHTVKYTPTQQGNMQVLVTYGGDPIPKSPFTVGVAAPLDLSKIKLNGLENRVEVGKDQEFTVDTRGAGGQGKLDVTILSPSRKVVPCLVTPVTGRENSTAKFIPREEGLYAVDVTYDGHPVPGSPYTVEASLPPDPSKVKAHGPGLEGGLVGKPAEFTIDTKGAGTGGLGLTVEGPCEAKIECSDNGDGTCSVSYLPTKPGEYFVNILFEEVHIPGSPFKADIEMPFDPSKVVASGPGLEHGKVGEAGLLSVNCSEAGPGALGLEAVSDSGTKAEVSIQNNKDGTYAVTYVPLTAGMYTLTMKYGGELVPHFPARVKVEPAVDTSRIKVFGPGIEGKDVFREATTDFTVDSRPLTQVGGDHIKAHIANPSGASTECFVTDNADGTYQVEYTPFEKGLHVVEVTYDDVPIPNSPFKVAVTEGCQPSRVQAQGPGLKEAFTNKPNVFTVVTRGAGIGGLGITVEGPSESKINCRDNKDGSCSAEYIPFAPGDYDVNITYGGAHIPGSPFRVPVKDVVDPSKVKIAGPGLGSGVRARVLQSFTVDSSKAGLAPLEVRVLGPRGLVEPVNMVDNGDGTHTVTYTPSQEGPYMVSVKYADEEIPRSPFKVKVLPTYDASKVTASGPGLSSYGVPASLPVDFAIDARDAGEGLLAVQITDQEGKPKRAIVHDNKDGTYAVTYIPDKTGRYMIGVTYGGDDIPLSPYRIRATQTGDASKCLATGPGIASTVKTGEEVGFVVDAKTAGKGKVTCTVLTPDGTEAEADVIENEDGTYDIFYTAAKPGTYVIYVRFGGVDIPNSPFTVMATDGEVTAVEEAPVNACPPGFRPWVTEEAYVPVSDMNGLGFKPFDLVIPFAVRKGEITGEVHMPSGKTATPEIVDNKDGTVTVRYAPTEVGLHEMHIKYMGSHIPESPLQFYVNYPNSGSVSAYGPGLVYGVANKTATFTIVTEDAGEGGLDLAIEGPSKAEISCIDNKDGTCTVTYLPTLPGDYSILVKYNDKHIPGSPFTAKITDDSRRCSQVKLGSAADFLLDISETDLSSLTASIKAPSGRDEPCLLKRLPNNHIGISFIPREVGEHLVSIKKNGNHVANSPVSIMVVQSEIGDARRAKVYGRGLSEGRTFEMSDFIVDTRDAGYGGISLAVEGPSKVDIQTEDLEDGTCKVSYFPTVPGVYIVSTKFADEHVPGSPFTVKISGEGRVKESITRTSRAPSVATVGSICDLNLKIPEINSSDMSAHVTSPSGRVTEAEIVPMGKNSHCVRFVPQEMGVHTVSVKYRGQHVTGSPFQFTVGPLGEGGAHKVRAGGPGLERGEAGVPAEFSIWTREAGAGGLSIAVEGPSKAEITFDDHKNGSCGVSYIAQEPGNYEVSIKFNDEHIPESPYLVPVIAPSDDARRLTVMSLQESGLKVNQPASFAIRLNGAKGKIDAKVHSPSGAVEECHVSELEPDKYAVRFIPHENGVHTIDVKFNGSHVVGSPFKVRVGEPGQAGNPALVSAYGTGLEGGTTGIQSEFFINTTRAGPGTLSVTIEGPSKVKMDCQETPEGYKVMYTPMAPGNYLISVKYGGPNHIVGSPFKAKVTGQRLVSPGSANETSSILVESVTRSSTETCYSAIPKASSDASKVTSKGAGLSKAFVGQKSSFLVDCSKAGSNMLLIGVHGPTTPCEEVSMKHVGNQQYNVTYVVKERGDYVLAVKWGEEHIPGSPFHVTVP

SEQ ID NO: 4 - DNA, 7809 bp, Homosapien
atgccggtaaccgagaaggatctagctgaggacgcgccttggaagaagatccagcagaacacgttcacacgctggtgcaacgagcacctcaagtgcgtgaacaaacgcatcggcaacctgcagaccgacctgagcgacgggctgcggctcatcgcgctgctcgaggtgctcagccagaagcgcatgtaccgcaagtaccatcagcggcccacctttcgccagatgcagctcgagaatgtgtccgtggcgctcgagttcctggaccgtgagagcatcaagctcgtgtccatcgatagcaaagccattgtggatgggaacctgaagctcatcttgggtctggtgtggacgctgatcctccactactccatctccatgcccgtgtgggaggatgaaggggatgatgatgccaagaagcagacgccaaagcagaggctgctggggtggattcagaacaagatcccctacttgcccatcaccaactttaaccagaactggcaagacggcaaagccctgggagccctggtagacagctgtgctccaggtctgtgcccagactgggaatcctgggacccgcagaagcctgtggataatgcacgagaagccatgcagcaggcagatgactggctgggtgtcccacaggtcatcactcctgaagaaatcattcacccggatgtggacgagcactcagttatgacttacctgtcccagttccccaaagccaagctcaagccgggggctcctctcaaacccaaactcaacccgaagaaagccagggcctatggcagaggaatcgagcccactggaaacatggtgaagcagccagccaagttcactgtggacaccatcagcgccgggcaaggagacgtgatggtgtttgttgaggacccagaagggaacaaagaggaggcacaagtgacccctgacagtgacaagaacaagacatactctgtggagtatctgcccaaggtcaccgggctacacaaagtcacagtcctctttgcaggacagcacatctccaagagcccatttgaagtgagtgttgacaaggcccagggagatgccagtaaagtcactgcaaaaggtccagggttggaagctgtagggaacatcgccaataagcccacctactttgacatctatacggcaggagctggtgtgggtgacattggtgtggaggtggaagatccccaggggaagaacaccgtggagttgctcgtggaagacaaaggaaaccaggtgtatcgatgtgtgtacaaacccatgcagcctggccctcacgtggtcaagatcttctttgctggggacactattcctaagagtcccttcgttgtgcaggttggggaagcctgcaatccaaatgcctgccgggccagtggccgaggcctacaacccaaaggcgtccgtatccgggagaccacagatttcaaggttgacaccaaagctgcaggaagtggggagctcggtgtaaccatgaagggtcctaagggtctggaggagctggtgaagcagaaagactttctggatggggtctacgcattcgagtattaccccagcaccccggggagatacagcattgccatcacatgggggggacaccacattccaaagagcccctttgaagttcaagttggccctgaagcgggtatgcagaaagtccgtgcttggggccctgggctccatggtgggattgtcgggcggtcagcggacttcgtggtagaatccattggctctgaagtggggtctctggggtttgccattgaaggcccctctcaggcaaagattgagtacaacgaccagaatgatggatcgtgtgatgtcaaatactggcccaaggagcctggcgaatatgctgttcacatcatgtgtgacgacgaagacatcaaggacagcccgtacatggccttcatccacccagccacgggaggctacaaccctgatctggttcgagcatacgggccaggtttggagaaatctggatgcattgtcaacaacctggccgagttcactgtggatcctaaggatgctggaaaagctcccttaaagatatttgctcaggatggggaaggccaacgcattgacatccagatgaagaaccggatggacggcacatatgcatgctcatacaccccggtgaaggccatcaagcacaccattgctgtggtctggggaggcgtgaacatcccgcacagcccctacagggtcaacatcgggcaaggtagccatcctcagaaggtcaaagtgtttgggccaggtgtggagagaagtggtctgaaggcaaatgaacctacacacttcacggtggactgtactgaggctggggaaggtgatgtcagtgttggcattaagtgtgatgcccgggtgttaagtgaagatgaggaagacgtggattttgacattattcacaatgccaatgatacgttcacagtcaaatatgtgcctcctgctgctgggcgatacactatcaaagttctctttgcatctcaggaaatccccgccagccctttcagagtcaaagttgacccttcccacgatgccagcaaagtgaaggcagaaggcccagggctcagcaaagcaggtgtggaaaatgggaaaccgacccacttcactgtctacaccaagggggctgggaaagccccgctcaacgtgcagttcaacagccctcttcctggcgatgcagtgaaggatttggatatcatcgataattatgactactctcacacggttaaatatacacccacccaacagggcaacatgcaggttctggtgacttacggtggcgatcccatccctaaaagccctttcactgtgggtgttgctgcaccgctggatctgagcaagataaaactcaatgggctggaaaacagggtggaagttgggaaggatcaggagttcaccgttgataccaggggggcaggaggccaggggaagctggacgtgacaatcctcagcccctctcggaaggtcgtgccatgcctagtgacacctgtgacaggccgggagaacagcacggccaagttcatccctcgggaggaggggctgtatgctgtagacgtgacctacgatggacaccctgtgcccgggagcccctacacagtggaggcctcgctgccaccagatcccagcaaggtgaaggcccacggtcccggcctcgaaggtggtctcgtgggcaagcctgccgagttcaccatcgataccaaaggagctggtactggaggtctgggcttaacggtggaaggtccgtgcgaggccaaaatcgagtgctccgacaatggtgatgggacctgctccgtctcttaccttcccacaaaacccggggagtacttcgtcaacatcctctttgaagaagtccacatacctgggtctcccttcaaagctgacattgaaatgccctttgacccctctaaagtcgtggcatcggggccaggtctcgagcacgggaaggtgggtgaagctggcctccttagcgtcgactgctcggaagcgggaccgggggccctgggcctggaagctgtctcggactcgggaacaaaagccgaagtcagtattcagaacaacaaagatggcacctacgcggtgacctacgtgcccctgacggccggcatgtacacgttgaccatgaagtatggtggcgaactcgtgccacacttccccgcccgggtcaaggtggagcccgccgtggacaccagcaggatcaaagtctttggaccaggaatagaagggaaagatgtgttccgggaagctaccaccgactttacagttgactctcggccgctgacccaggttgggggtgaccacatcaaggcccacattgccaacccctcaggggcctccaccgagtgctttgtcacagacaatgcggatgggacctaccaggtggaatacacaccctttgagaaaggtctccatgtagtggaggtgacatatgatgacgtgcctatcccaaacagtcccttcaaggtggctgtcactgaaggctgccagccatctagggtgcaagcccaaggacctggattgaaagaggcctttaccaacaagcccaatgtcttcaccgtggttaccagaggcgcaggaattggtgggcttggcataactgttgagggaccatcagagtcgaagataaattgcagagacaacaaggatggcagctgcagtgctgagtacattcctttcgcaccgggggattacgatgttaatatcacatatggaggagcccacatccccggcagccccttcagggttcctgtgaaggatgttgtggaccccagcaaggtcaagattgccggccccgggctgggctcaggcgtccgagcccgtgtcctgcagtccttcacggtggacagcagcaaggctggcctggctccgctggaagtgagggttctgggcccacgaggcttggtggagccagtgaacgtggtggacaatggagatggcacacacacagtaacctacaccccatctcaggagggaccttacatggtctcagttaaatatgctgatgaagagattcctcgcagtcccttcaaggtcaaggtccttcccacatatgatgccagcaaagtgactgccagtggccccggccttagttcctatggtgtgcctgccagtctacctgtggactttgcaattgatgcccgagatgccggggaaggcctgcttgctgttcaaataacggaccaagaaggaaaacccaaaagagccattgtccatgacaataaagatggcacgtatgctgtcacctacatccccgacaagactgggcgctatatgattggagtcacctacgggggtgacgacatcccactttctccttatcgcatccgagccacacagacgggtgatgccagcaagtgcctggccacgggtcctggaatcgcctccactgtgaaaactggcgaagaagtaggctttgtggttgatgccaagactgccgggaagggtaaagtgacctgcacggttctgaccccagatggcactgaggccgaggccgatgtcattgagaatgaagatggaacctatgacatcttctacacagctgccaagccgggcacatatgtgatctatgtgcgcttcggtggtgttgatattcctaacagccccttcactgtcatggccacagatggggaagtcacagccgtggaggaggcaccggtaaatgcatgtccccctggattcaggccctgggtgaccgaagaggcctatgtcccagtgagtgacatgaacggcctgggatttaagccttttgacctggtcattccgtttgctgtcaggaaaggagaaatcactggagaggtccacatgccttctgggaagacagccacacctgagattgtggacaacaaggacggcacggtcactgttagatatgcccccactgaggtcgggctccatgagatgcacatcaaatacatgggcagccacatccctgagagcccactccagttctacgtgaactaccccaacagtggaagtgtttctgcatacggtccaggcctcgtgtatggagtggccaacaaaactgccaccttcaccatcgtcacagaggatgcaggagaaggtggtctggacttggctattgagggcccctcaaaagcagaaatcagctgcattgacaataaagatgggacatgcacagtgacctacctgccgactctgccaggcgactacagcattctggtcaagtacaatgacaagcacatccctggcagccccttcacagccaagatcacagatgacagcaggcggtgctcccaggtgaagttgggctcagccgctgacttcctgctcgacatcagtgagactgacctcagcagcctgacggccagcattaaggccccatctggccgagacgagccctgtctcctgaagaggctgcccaacaaccacattggcatctccttcatcccccgggaagtgggcgaacatctggtcagcatcaagaaaaatggcaaccatgtggccaacagccccgtgtctatcatggtggtccagtcggagattggtgacgcccgccgagccaaagtctatggccgcggcctgtcagaaggccggactttcgagatgtctgacttcatcgtggacacaagggatgcaggttatggtggcatatccttggcggtggaaggccccagcaaagtggacatccagacggaggacctggaagatggcacctgcaaagtctcctacttccctaccgtgcctggggtttatatcgtctccaccaaattcgctgacgagcacgtgcctgggagcccatttaccgtgaagatcagtggggagggaagagtcaaagagagcatcacccgcaccagtcgggccccgtccgtggccactgtcgggagcatttgtgacctgaacctgaaaatcccagaaatcaacagcagtgatatgtcggcccacgtcaccagcccctctggccgtgtgactgaggcagagattgtgcccatggggaagaactcacactgcgtccggtttgtgccccaggagatgggcgtgcacacggtcagcgtcaagtaccgtgggcagcacgtcaccggcagccccttccagttcaccgtggggccacttggtgaaggaggcgcccacaaggtgcgggcaggaggccctggcctggagagaggagaagcgggagtcccagctgagttcagcatttggacccgggaagcaggcgctggaggcctctccatcgctgttgagggccccagtaaggccgagattacattcgatgaccataaaaatgggtcgtgcggtgtatcttatattgcccaagagcctggtaactacgaggtgtccatcaagttcaatgatgagcacatcccggaaagcccctacctggtgccggtcatcgcaccctccgacgacgcccgccgcctcactgttatgagccttcaggaatcgggattaaaagttaaccagccagcatcctttgctataaggttgaatggcgcaaaaggcaagattgatgcaaaggtgcacagcccctctggagccgtggaggagtgccacgtgtctgagctggagccagataagtatgctgttcgcttcatccctcatgagaatggtgtccacaccatcgatgtcaagttcaatgggagccacgtggttggaagccccttcaaagtgcgcgttggggagcctggacaagcggggaaccctgccctggtgtccgcctatggcacgggactcgaagggggcaccacaggtatccagtcggaattctttattaacaccacccgagcaggtccagggacattatccgtcaccatcgaaggcccatccaaggttaaaatggattgccaggaaacacctgaagggtacaaagtcatgtacacccccatggctcctggtaactacctgatcagcgtcaaatacggtgggcccaaccacatcgtgggcagtcccttcaaggccaaggtgacaggccagcgtctagttagccctggctcagccaacgagacctcatccatcctggtggagtcagtgaccaggtcgtctacagagacctgctatagcgccattcccaaggcatcctcggacgccagcaaggtgacctctaagggggcagggctctcaaaggcctttgtgggccagaagagttccttcctggtggactgcagcaaagctggctccaacatgctgctgatcggggtccatgggcccaccaccccctgcgaggaggtctccatgaagcatgtaggcaaccagcaatacaacgtcacatacgtcgtcaaggagaggggcgattatgtgctggctgtgaagtggggggaggaacacatccctggcagcccttttcatgtcacagtgccttaa

SEQ ID NO: 5 - protein, 370 aa, Homosapien
MAAERQEALREFVAVTGAEEDRARFFLESAGWDLQIALASFYEDGGDEDIVTISQATPSSVSRGTAPSDNRVTSFRDLIHDQDEDEEEEEGQRFYAGGSERSGQQIVGPPRKKSPNELVDDLFKGAKEHGAVAVERVTKSPGETSKPRPFAGGGYRLGAAPEEESAYVAGEKRQHSSQDVHVVLKLWKSGFSLDNGELRSYQDPSNAQFLESIRRGEVPAELRRLAHGGQVNLDMEDHRDEDFVKPKGAFKAFTGEGQKLGSTAPQVLSTSSPAQQAENEAKASSSILIDESEPTTNIQIRLADGGRLVQKFNHSHRISDIRLFIVDARPAMAATSFILMTTFPNKELADESQTLKEANLLNAVIVQRLT

SEQ ID NO: 6 - DNA, 1113 bp, Homosapien
atggcggcggagcgacaggaggcgctgagggagttcgtggcggtgacgggcgccgaggaggaccgggcccgcttctttctcgagtcggccggctgggacttgcagatcgcgctagcgagcttttatgaggacggaggggatgaagacattgtgaccatttcgcaggcaacccccagttcagtgtccagaggcacagcccccagtgataatagagtgacatccttcagagacctcattcatgaccaagatgaagatgaggaggaagaggaaggccagaggttttatgctgggggctcagagagaagtggacagcagattgttggccctcccaggaagaaaagtcccaacgagctggtggatgatctctttaaaggtgccaaagagcatggagctgtagctgtggagcgagtgaccaagagccctggagagaccagtaaaccgagaccatttgcaggaggtggctaccgccttggggcagcaccagaggaagagtctgcctatgtggcaggagaaaagaggcagcattccagccaagatgttcatgtagtattgaaactctggaagagtggattcagcctggataatggagaactcagaagctaccaagacccatccaatgcccagtttctggagtctatccgcagaggggaggtgccagcagagcttcggaggctagctcacggtggacaggtgaacttggatatggaggaccatcgggacgaggactttgtgaagcccaaaggagccttcaaagccttcactggcgagggtcagaaactgggcagcactgccccccaggtgttgagtaccagctctccagcccaacaggcagaaaatgaagccaaagccagctcttccatcttaatcgacgaatcagagcctaccacaaacatccaaattcggcttgcagacggcgggaggctggtgcagaaatttaaccacagccacaggatcagcgacatccgactcttcatcgtggatgcccggccagccatggctgccaccagctttatcctcatgactactttcccgaacaaagagctggctgatgagagccagaccctgaaggaagccaacctgctcaatgctgtcatcgtgcagcggttaacataa

SEQ ID NO: 7 - protein, 261 aa, Homosapien
MTCWLRGVTATFGRPAEWPGYLSHLCGRSAAMDLGPMRKSYRGDREAFEETHLTSLDPVKQFAAWFEEAVQCPDIGEANAMCLATCTRDGKPSARMLLLKGFGKDGFRFFTNFESRKGKELDSNPFASLVFYWEPLNRQVRVEGPVKKLPEEEAECYFHSRPKSSQIGAVVSHQSSVIPDREYLRKKNEELEQLYQDQEVPKPKSWGGYVLYPQVMEFWQGQTNRLHDRIVFRRGLPTGDSPLGPMTHRGEEDWLYERLAP

SEQ ID NO: 8 - DNA, 786 bp, Homosapien
atgacgtgctggctgcggggcgtcacggcgacgttcgggcgacctgccgagtggccaggctacctcagtcacctgtgtggtcgcagtgctgccatggacctgggacccatgcgcaagagttaccgcggggaccgagaggcatttgaggagactcatctgacctcccttgacccagtgaaacagtttgctgcctggtttgaggaggctgttcagtgtcctgacataggggaagccaatgccatgtgtctggctacctgcaccagagatggaaaaccctctgctcgcatgttgctgctgaagggcttcgggaaagatggcttccgcttcttcactaacttcgagagtcgaaaaggaaaagagctggactctaatccctttgcttcccttgtcttctactgggagccacttaaccgtcaggtgcgtgtggaaggccctgtgaagaaactgcctgaggaggaggctgagtgctacttccactcccgccccaagagcagccagattggggctgtggtcagccaccagagttctgtgatccctgatcgggagtatctgagaaagaaaaatgaggaactggaacagctctaccaggatcaagaggtgcccaagccaaaatcctggggtggctatgtcctgtaccctcaggtgatggagttctggcaaggtcaaaccaaccgcctgcatgaccggatagtctttcggcggggcctacccacaggagattcccctttggggcccatgacccaccgcggggaggaagactggctctatgagagacttgcaccttaa

SEQ ID NO: 9 - protein, 343 aa, Homosapien
MGGPRGAGWVAAGLLLGAGACYCIYRLTRGRRRGDRELGIRSSKSAGALEEGTSEGQLCGRSARPQTGGTWESQWSKTSQPEDLTDGSYDDVLNAEQLQKLLYLLESTEDPVIIERALITLGNNAAFSVNQAIIRELGGIPIVANKINHSNQSIKEKALNALNNLSVNVENQIKIKIYISQVCEDVFSGPLNSAVQLAGLTLLTNMTVTNDHQHMLHSYITDLFQVLLTGNGNTKVQVLKLLLNLSENPAMTEGLLRAQVDSSFLSLYDSHVAKEILLRVLTLFQNIKNCLKIEGHLAVQPTFTEGSLFFLLHGEECAQKIRALVDHHDAEVKEKVVTIIPKI

SEQ ID NO: 10 - DNA, 1032 bp, Homosapien
atgggtggcccccggggcgcgggctgggtggcggcgggcctgctgctcggcgcgggcgcctgctactgcatttacaggctgacccggggtcggcggcggggcgaccgcgagctcgggatacgctcttcgaagtccgcaggtgccctggaagaagggacgtcagagggtcagttgtgcgggcgctcggcccggcctcagacgggaggtacctgggagtcacagtggtccaagacctcgcagcctgaagacttaactgatggttcatatgatgatgttctaaatgctgaacaacttcagaaactcctttacctgctggagtcaacggaggatcctgtaattattgaaagagctttgattactttgggtaacaatgcagccttttcagttaaccaagctattattcgtgaattgggtggtattccaattgttgcaaacaaaatcaaccattccaaccagagtattaaagagaaagctttaaatgcactaaataacctgagtgtgaatgttgaaaatcaaatcaagataaagatatacatcagtcaagtatgtgaggatgtcttctctggtcctctgaactctgctgtgcagctggctggactgacattgttgacaaacatgactgttaccaatgaccaccagcacatgcttcacagttacattacagacctgttccaggtgttacttactggaaatggaaacacgaaggtgcaagttttgaaactgcttttgaatttgtctgaaaatccagccatgacagaaggacttctccgtgcccaagtggattcatcattcctttccctttatgacagccacgtagcaaaggagattcttcttcgagtacttacgctatttcagaatataaagaactgcctcaaaatagaaggccatttagctgtgcagcctactttcactgaaggttcattgtttttcctgttacatggagaagaatgtgcccagaaaataagagctttagttgatcaccatgatgcagaggtgaaggaaaaggttgtaacaataatacccaaaatctga

SEQ ID NO: 11 - protein, 573 aa, Homosapien
MLRLPTVFRQMRPVSRVLAPHLTRAYAKDVKFGADARALMLQGVDLLADAVAVTMGPKGRTVIIEQSWGSPKVTKDGVTVAKSIDLKDKYKNIGAKLVQDVANNTNEEAGDGTTTATVLARSIAKEGFEKISKGANPVEIRRGVMLAVDAVIAELKKQSKPVTTPEEIAQVATISANGDKEIGNIISDAMKKVGRKGVITVKDGKTLNDELEIIEGMKFDRGYISPYFINTSKGQKCEFQDAYVLLSEKKISSIQSIVPALEIANAHRKPLVIIAEDVDGEALSTLVLNRLKVGLQVVAVKAPGFGDNRKNQLKDMAIATGGAVFGEEGLTLNLEDVQPHDLGKVGEVIVTKDDAMLLKGKGDKAQIEKRIQEIIEQLDVTTSEYEKEKLNERLAKLSDGVAVLKVGGTSDVEVNEKKDRVTDALNATRAAVEEGIVLGGGCALLRCIPALDSLTPANEDQKIGIEIIKRTLKIPAMTIAKNAGVEGSLIVEKIMQSSSEVGYDAMAGDFVNMVEKGIIDPTKVVRTALLDAAGVASLLTTAEVVVTEIPKEEKDPGMGAMGGMGGGMGGGMF

SEQ ID NO: 12 - DNA, 1722 bp, Homosapien
atgcttcggttacccacagtctttcgccagatgagaccggtgtccagggtactggctcctcatctcactcgggcttatgccaaagatgtaaaatttggtgcagatgcccgagccttaatgcttcaaggtgtagaccttttagccgatgctgtggccgttacaatggggccaaagggaagaacagtgattattgagcagagttggggaagtcccaaagtaacaaaagatggtgtgactgttgcaaagtcaattgacttaaaagataaatacaaaaacattggagctaaacttgttcaagatgttgccaataacacaaatgaagaagctggggatggcactaccactgctactgtactggcacgctctatagccaaggaaggcttcgagaagattagcaaaggtgctaatccagtggaaatcaggagaggtgtgatgttagctgttgatgctgtaattgctgaacttaaaaagcagtctaaacctgtgaccacccctgaagaaattgcacaggttgctacgatttctgcaaacggagacaaagaaattggcaatatcatctctgatgcaatgaaaaaagttggaagaaagggtgtcatcacagtaaaggatggaaaaacactgaatgatgaattagaaattattgaaggcatgaagtttgatcgaggctatatttctccatactttattaatacatcaaaaggtcagaaatgtgaattccaggatgcctatgttctgttgagtgaaaagaaaatttctagtatccagtccattgtacctgctcttgaaattgccaatgctcaccgtaagcctttggtcataatcgctgaagatgttgatggagaagctctaagtacactcgtcttgaataggctaaaggttggtcttcaggttgtggcagtcaaggctccagggtttggtgacaatagaaagaaccagcttaaagatatggctattgctactggtggtgcagtgtttggagaagagggattgaccctgaatcttgaagacgttcagcctcatgacttaggaaaagttggagaggtcattgtgaccaaagacgatgccatgctcttaaaaggaaaaggtgacaaggctcaaattgaaaaacgtattcaagaaatcattgagcagttagatgtcacaactagtgaatatgaaaaggaaaaactgaatgaacggcttgcaaaactttcagatggagtggctgtgctgaaggttggtgggacaagtgatgttgaagtgaatgaaaagaaagacagagttacagatgcccttaatgctacaagagctgctgttgaagaaggcattgttttgggagggggttgtgccctccttcgatgcattccagccttggactcattgactccagctaatgaagatcaaaaaattggtatagaaattattaaaagaacactcaaaattccagcaatgaccattgctaagaatgcaggtgttgaaggatctttgatagttgagaaaattatgcaaagttcctcagaagttggttatgatgctatggctggagattttgtgaatatggtggaaaaaggaatcattgacccaacaaaggttgtgagaactgctttattggatgctgctggtgtggcctctctgttaactacagcagaagttgtagtcacagaaattcctaaagaagagaaggaccctggaatgggtgcaatgggtggaatgggaggtggtatgggaggtggcatgttctaa

SEQ ID NO: 13 - protein, 1430 aa, Homosapien
MSRPSSVSPRQPAPGGGGGGGPSPCGPGGGGRAKGLKDIRIDEEVKIAVNIALERFRYGDQREMEFPSSLTSTERAFIHRLSQSLGLVSKSKGKGANRYLTVKKKDGSETASKTSGRLNNGIPQIPVKRGESEFDSFRQSLPVFEKQEEIVKIIKENKVVLIVGETGSGKTTQIPQFLLDDCFKNGIPCRIFCTQPRRLAAIAVAERVAAERRERIGQTIGYQIRLESRVSPKTLLTFCTNGVLLRTLMAGDSTLSTVTHVIVDEVHERDRFSDFLLTKLRDLLQKHPTLKLILSSAALDVNLFIRYFGSCPVIYIQGRPFEVKEMFLEDILRTTGYTNKEMLKYKKEKQQEEKQQTTLTEWYSAQENSFKPESQRQRTVLNVTDEYDLLDDGGDAVFSQLTEKDVNCLEPWLIKEMDACLSDIWLHKDIDAFAQVFHLILTENVSVDYRHSETSATALMVAAGRGFASQVEQLISMGANVHSKASNGWMALDWAKHFGQTEIVDLLESYSASLEFGNLDESSLVQTNGSDLSAEDRELLKAYHHSFDDEKVDLDLIMHLLYNICHSCDAGAVLIFLPGYDEIVGLRDRILFDDKRFADNTHRYQVFMLHSNMQTSDQKKVLKNPPAGVRKIILSTNIAETSITVNDVVFVIDSGKVKEKSFDALNFVTMLKMVWISKASAIQRKGRAGRCRPGICFRLFSRLRFQNMLEFQTPELLRMPLQELCLHTKLLAPVNCPIADFLMKAPEPPPALIVRNAVQMLKTIDAMDTWEDLTELGYHLADLPVEPHLGKMVLCAVVLKCLDPILTIACTLAYRDPFVLPTQASQKRAAMLCRKRFTAGAFSDHMALLRAFQAWQKARSDGWERAFCEKNFLSQATMEIIIGMRTQLLGQLRASGFVRARGGGDIRDVNTNSENWAVVKAALVAGMYPNLVHVDRENLVLTGPKEKKVRFHPASVLSQPQYKKIPPANGQAAAIKALPTDWLIYDEMTRAHRIANIRCCSAVTPVTILVFCGPARLASNALQEPSSFRVDGIPNDSSDSEMEDKTTANLAALKLDEWLHFTLEPEAASLLLQLRQKWHSLFLRRMRAPSKPWSQVDEATIRAIIAVLSTEEQSAGLQQPSGIGQRPRPMSSEELPLASSWRSNNSRKSSADTEFSDECTTAERVLMKSPSPALHPPQKYKDRGILHPKRGTEDRSDQSSLKSTDSSSYPSPCASPSPPSSGKGSKSPSPRPNMPVRYFIMKSSNLRNLEISQQKGIWSTTPSNERKLNRAFWESSIVYLVFSVQGSGHFQGFSRMSSEIGREKSQDWGSAGLGGVFKVEWIRKESLPFQFAHHLLNPWNDNKKVQISRDGQELEPLVGEQLLQLWERLPLGEKNTTDHAMMTCNLTHNTKHAVRSLIQRFPVTNKERTELLPKTERGNVFAVEAENREM

SEQ ID NO: 14 - DNA, 4293 bp, Homosapien
atgtccaggccgagcagcgtctccccgcggcagccggctcctggcggtggcggaggcggcggcccctcgccttgtggccctgggggcggcggccgggccaaggggctgaaggacattcgcattgatgaggaggtgaagatcgcagtcaatatcgcgctggagcgcttccgatacggggaccagagagaaatggaatttccttcttctttgaccagtactgaaagagcctttattcatcgactcagtcagtctcttggtttggtctctaaaagtaaaggaaagggagcaaatagatacctaactgtgaagaagaaagatggatcagaaacagctcatgcaatgatgacctgtaatttgactcataatacaaaacatgctgttaggagcctaattcaaagatttcctgtcaccaataaagagcgtacagaacttctgcctaaaacagaaagaggaaatgtgtttgcagttgaagctgaaaaccgggaaatgagcaagacaagtgggcgactcaacaatggcatacctcagattccagtgaaaagaggagaatccgaatttgattcttttaggcagtctttaccagtgtttgagaaacaggaagaaattgttaaaataattaaggaaaataaagtagttttgattgtaggagaaactgggtctggaaagaccacacagattcctcagttccttttagatgattgctttaaaaatggtatcccctgccgtatattttgtactcaaccaagacgattggcagctatcgctgtggctgaaagagttgccgcagagagacgggaaaggattggtcaaacaattggttatcagatccgattagaaagcagggtttctccaaagacacttctgacattttgtactaatggggtattgcttcgtacattgatggcaggagatagtacgttgtcgactgtgacacatgttatcgtggatgaagtgcatgaaagggatcgatttagtgattttttacttacaaagttaagagatttgttgcaaaagcacccaactttgaaactaattctttctagtgctgccttggatgtaaatctctttataagatattttggaagttgtccagtgatatatatacagggaagaccatttgaagtaaaagaaatgtttctggaagatattttaagaacaactggatatacaaacaaagaaatgttaaaatataaaaaggaaaaacagcaagaagagaaacaacaaaccacacttacagaatggtactcagctcaagaaaatagtttcaagcctgaatctcagaggcagagaactgttctaaatgtgactgatgagtatgacttactggatgatggtggtgatgctgtcttcagtcagctgactgaaaaagatgtgaattgccttgaaccatggttaataaaggaaatggatgcttgcctttctgatatatggctacataaagatattgatgcctttgctcaggtctttcatctcattttaactgaaaatgttagtgttgattacagacatagtgaaaccagtgcaacagctctgatggttgctgcaggacgtggctttgcaagtcaagtagaacagttaatcagtatgggagccaatgtccatagtaaagcatcaaatggctggatggcattggattgggctaaacactttgggcagactgaaattgtggatcttctagaatcttacagtgcttcactggaatttggaaatctagatgaaagttctctggttcaaacaaatggaagtgacctcagtgctgaagacagagagctcctgaaagcttatcatcatagtttcgatgatgaaaaagtagacttggatttgatcatgcatcttctatacaatatctgccatagttgtgatgctggtgcagtactaatttttctgcctggatatgacgaaattgttggactgagagatcgcatcctgtttgatgacaagcggtttgctgacaatacacatagataccaagtctttatgcttcattcaaatatgcaaacatccgatcaaaagaaagtattaaaaaacccacctgcaggtgttcgaaaaataattctttccaccaatattgctgaaaccagcatcacagtcaatgatgttgtctttgttattgattctggtaaggtgaaagagaaatcctttgatgctctgaattttgttacaatgttaaaaatggtatggatttccaaagctagtgccatacagcggaaaggcagggcagggcgatgtagacctggaatttgttttcgtctgttcagtagactccgattccagaatatgttggaatttcagactccggaacttttgagaatgccattacaggaactttgcttacataccaagctgttagccccagttaattgtcccattgctgattttcttatgaaagctcctgaacctccaccagctttaattgtaagaaatgctgtacaaatgcttaagacaatagatgcaatggatacatgggaagatctgactgaacttgggtatcatttggctgacttgccagtagaaccacatcttggtaaaatggtcttgtgtgctgttgttttaaagtgtctggaccccatccttacaattgcttgcacactagcttatcgagatccttttgtactacctactcaggcctctcaaaaacgtgcagctatgctttgtaggaaacgttttactgcaggagctttcagtgaccatatggcacttctcagagcattccaggcctggcaaaaagcacgaagtgatgggtgggagcgagccttttgtgaaaagaattttctttcacaggctactatggaaataatcataggcatgagaacacagttgcttggtcaacttagagcatcaggttttgttagagcacgaggtggtggtgacattcgggacgttaacacaaactctgagaattgggctgtcgttaaagctgcattggtggcaggcatgtatcctaatttagtccacgtggacagagagaatctagtgttgacagggccaaaggagaaaaaagtacgatttcatcctgcttcagttctcagtcagcctcaatataaaaagattcctccagccaatggtcaagctgcagcaattaaggcactgcccacagattggcttatttatgatgaaatgaccagagcccatagaatagctaatattagatgttgttcagcagtgacgcctgtcactatattggtattctgtggaccagctagattggcaagtaatgctcttcaggaaccttcatcctttagagtggatggcattcccaatgacagtagtgatagtgaaatggaggacaaaactacagctaatttggcagccttgaaacttgatgagtggctccatttcacactggagccagaggcagctagtttattgctgcagctcagacagaagtggcatagcttatttttacgccgaatgagagctccatctaaaccttggtctcaagttgatgaagctaccataagagcaattatagctgttttaagcactgaagaacagtctgcaggtttacaacaaccatctgggattggccaaaggccaaggcctatgtcttcagaagagcttcctttggcctcatcttggaggtcaaataatagtaggaaaagttcagcagatactgaattttctgatgagtgtactactgcagaaagagtactgatgaaatctccatctccagcattacacccacctcagaagtacaaagatagaggaattttacatcctaaacgaggtactgaggaccgatcagatcagtcttctctgaaatctacagacagcagtagttacccaagtccttgtgctagtccttctcctccatcctcaggaaagggctcaaaatctccttcgccaagaccaaacatgcctgttcgatacttcataatgaagagtagcaatttgagaaaccttgaaatttctcaacagaagggtatctggtctacaactcctagtaatgaacggaagctaaatcgagccttttgggaaagcagcatagtttacttggtattttctgttcaaggatctggacatttccagggattttctaggatgtcttctgagattggaagggaaaagagtcaggactggggctctgctggactaggaggagtatttaaggtggagtggatacgaaaagaaagccttccctttcaatttgcacaccatttactcaatccatggaatgacaacaagaaagtgcagataagcagggatgggcaggaactagaacctctggttggtgaacagttgctccagttatgggaacgtcttcccttgggagaaaaaaacacaactgattga

SEQ ID NO: 15 - protein, 541 aa, Homosapien
MASMGTLAFDEYGRPFLIIKDQDRKSRLMGLEALKSHIMAAKAVANTMRTSLGPNGLDKMMVDKDGDVTVTNDGATILSMMDVDHQIAKLMVELSKSQDDEIGDGTTGVVVLAGALLEEAEQLLDRGIHPIRIADGYEQAARVAIEHLDKISDSVLVDIKDTEPLIQTAKTTLGSKVVNSCHRQMAEIAVNAVLTVADMERRDVDFELIKVEGKVGGRLEDTKLIKGVIVDKDFSHPQMPKKVEDAKIAILTCPFEPPKPKTKHKLDVTSVEDYKALQKYEKEKFEEMIQQIKETGANLAICQWGFDDEANHLLLQNNLPAVRWVGGPEIELIAIATGGRIVPRFSELTAEKLGFAGLVQEISFGTTKDKMLVIEQCKNSRAVTIFIRGGNKMIIEEAKRSLHDALCVIRNLIRDNRVVYGGGAAEISCALAVSQEADKCPTLEQYAMRAFADALEVIPMALSENSGMNPIQTMTEVRARQVKEMNPALGIDCLHKGTNDMKQQHVIETLIGKKQQISLATQMVRMILKIDDIRKPGESEE

SEQ ID NO: 16 - DNA, 1626 bp, Homosapien
atggcgtccatggggaccctcgccttcgatgaatatgggcgccctttcctcatcatcaaggatcaggaccgcaagtcccgtcttatgggacttgaggccctcaagtctcatataatggcagcaaaggctgtagcaaatacaatgagaacatcacttggaccaaatgggcttgataagatgatggtggataaggatggagatgtgactgtaactaatgatggggccaccatcttaagcatgatggatgttgatcatcagattgccaagctgatggtggaactgtccaagtctcaggatgatgaaattggagatggaaccacaggagtggttgtcctggctggtgccttgttagaagaagcggagcaattgctagaccgaggcattcacccaatcagaatagccgatggctatgagcaggctgctcgtgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaaattaaagagactggtgctaacctagcaatttgtcagtggggctttgatgatgaagcaaatcacttacttcttcagaacaacttgcctgcggttcgctgggtaggaggacctgaaattgagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatgatcattgaggaggcgaaacgatcccttcacgatgctttgtgtgtcatccggaacctcatccgcgataatcgtgtggtgtatggaggaggggctgctgagatatcctgtgccctggcagttagccaagaggcggataagtgccccaccttagaacagtatgccatgagagcgtttgccgacgcactggaggtcatccccatggccctctctgaaaacagtggcatgaatcccatccagactatgaccgaagtccgagccagacaggtgaaggagatgaaccctgctcttggcatcgactgtttgcacaaggggacaaatgatatgaagcaacagcatgtcatagaaaccttgattggcaaaaagcaacagatatctcttgcaacacaaatggttagaatgattttgaagattgatgacattcgtaagcctggagaatctgaagaatga

SEQ ID NO: 17 - protein, 1159 aa, Homosapien
MLDFLAENNLCGQAILRIVSCGNAIIAELLRLSEFIPAVFRLKDRADQQKYGDIIFDFSYFKGPELWESKLDAKPELQDLDEEFRENNIEIVTRFYLAFQSVHKYIVDLNRYLDDLNEGVYIQQTLETVLLNEDGKQLLCEALYLYGVMLLVIDQKIEGEVRERMLVSYYRYSAARSSADSNMDDICKLLRSTGYSSQPGAKRPSNYPESYFQRVPINESFISMVIGRRRSDDIYNQVSAYPLPEHRSTALANQAAMLYVILYFEPSILHTHQAKMREIVDKYFPDNWVISIYMGITVNLVDAWEPYKAAKTALNNTLDLSNVREQASRYATVSERVHAQVQQFLKEGYLREEMVLDNIPKLLNCLRDCNVAIRWLMLHTADSACDPNNKRLRQIKDQILTDSRYNPRILFQLLLDTAQFEFILKEMFKQMLSEKQTKWEHYKKEGSERMTELADVFSGVKPLTRVEKNENLQAWFREISKQILSLNYDDSTAAGRKTVQLIQALEEVQEFHQLESNLQVCQFLADTRKFLHQMIRTINIKEEVLITMQIVGDLSFAWQLIDSFTSIMQESIRVNPSMVTKLRATFLKLASALDLPLLRINQANSPDLLSVSQYYSGELVSYVRKVLQIIPESMFTSLLKIIKLQTHDIIEVPTRLDKDKLRDYAQLGPRYEVAKLTHAISIFTEGILMMKTTLVGIIKVDPKQLLEDGIRKELVKRVAFALHRGLIFNPRAKPSELMPKLKELGATMDGFHRSFEYIQDYVNIYGLKIWQEEVSRIINYNVEQECNNFLRTKIQDWQSMYQSTHIPIPKFTPVDESVTFIGRLCREILRITDPKMTCHIDQLNTWYDMKTHQEVTSSRLFSEIQTTLGTFGLNGLDRLLCFMIVKELQNFLSMFQKIILRDRTVQDTLKTLMNAVSPLKSIVANSNKIYFSAIAKTQKIWTAYLEAIMKVGQMQILRQQIANELNYSCRFDSKHLAAALENLNKALLADIEAHYQDPSLPYPKEDNTLLYEITAYLEAAGIHNPLNKIYITTKRLPYFPIVNFLFLIAQLPKLQYNKNLGMVCRKPTDPVDWPPLVLGLLTLLKQFHSRYTEQFLALIGQFICSTVEQCTSQKIPEIPADVVGALLFLEDYVRYTKLPRRVAEAHVPNFIFDEFRTVL

SEQ ID NO: 18 - DNA, 3480 bp, Homosapien
atgttggactttctagctgagaacaacctctgtggccaagcaatcctaaggattgtttcctgtggtaatgccatcattgctgaacttttgagactctctgagtttattcctgctgtgttcaggttaaaagacagagctgatcaacagaaatatggagatatcatatttgatttcagctattttaagggtccagaattatgggaaagcaaactggatgctaagccagagctacaggatttagatgaagaatttcgtgaaaacaacatagaaattgtgaccagattttatttagcatttcaaagtgtacataaatatattgtagacttaaacagatatctagatgatctcaatgaaggggtttatattcagcaaaccttagaaactgtgcttctcaatgaagatggaaaacaacttctatgtgaagcactgtacttatatggagttatgctactggtcattgaccaaaagattgaaggagaagtcagagagaggatgctggtttcttactaccgatacagtgctgctcgatcttctgctgattcaaatatggacgatatttgtaagctgcttcgaagtacaggttattctagccaaccaggtgccaaaagaccatccaactatcccgagagctatttccagagagtgcctatcaacgaatccttcatcagtatggtcattggtcgacggagatctgatgatatttacaaccaggtctcagcgtatcctttgccggagcatcgcagcacagccctggcaaaccaagctgccatgctgtacgtgattctctactttgagccttccatccttcacacccatcaagcaaaaatgagagagatagtggataaatactttccagataattgggtaattagtatttacatggggatcacagttaatctagtagatgcttgggaaccttacaaagctgcaaaaactgctttaaataataccctggacctttcaaatgtcagagaacaggcaagcagatatgctactgtcagtgaaagagtgcatgctcaagtgcagcaatttctaaaagaaggttatttaagggaggagatggttctggacaatatcccaaagcttctgaactgcctgagagactgcaatgttgccatccgatggctgatgcttcatacagcagactcagcctgtgacccaaacaacaaacgccttcgtcaaatcaaggaccagattctaacagactctcggtacaatcccaggatcctcttccagctgctgttagatactgcacaatttgagtttatactcaaagagatgttcaagcaaatgctttcagaaaagcaaaccaaatgggagcattacaagaaagagggttcggagcggatgactgagcttgctgatgtcttttcaggagtgaaacccctaaccagagtggagaaaaatgaaaaccttcaagcttggttcagagagatctcaaaacaaatattgtctttaaattatgatgattctactgctgcgggcagaaaaactgtacaactgatacaagctttggaagaggttcaagaattccaccagttggaatccaatctgcaagtatgtcagtttcttgccgatactcgaaagtttcttcatcaaatgatcagaaccattaacattaaagaggaggttctgatcacaatgcagatcgttggggacctttctttcgcttggcagttgattgacagtttcacatccatcatgcaagaaagcataagggtaaatccatccatggttactaaactcagagctaccttcctaaagcttgcctctgccctcgatctgccccttcttcgtattaatcaggcaaatagccccgacctgctcagcgtgtcacagtactattctggagagttggtatcctatgtgagaaaagttttgcagatcatcccagaaagcatgtttacatctcttctaaagatcataaagcttcagacccacgacattattgaagtgcctacccgcctggacaaagacaagctgagggactatgctcagctaggcccacgatacgaggttgccaagcttactcatgctatttccatttttactgaaggcatcttaatgatgaaaacgactttggttggcatcatcaaggtggatccaaagcagttgctggaagatggaataaggaaagagcttgtgaagcgcgttgcctttgccctgcataggggactgatattcaaccctcgagccaagccaagtgaattgatgcccaagctgaaagagttgggagcgaccatggatggattccatcgttcttttgaatacatacaggactatgtcaacatttatggtctgaagatttggcaggaagaagtatctcgtatcataaattacaacgtggagcaagagtgtaataactttctaagaacgaagattcaagattggcaaagcatgtaccagtccactcatattccaatacccaagtttacccctgtggatgagtctgtaacgtttattggtcgactctgcagagaaatcctgcggatcacagacccaaaaatgacatgtcacatagaccagctgaacacttggtatgatatgaaaactcatcaggaagtgaccagcagccgcctcttctcagaaatccagaccaccttgggaacctttggtctaaatggcttagacaggcttctgtgctttatgattgtaaaagagttacagaatttcctcagtatgtttcagaaaattatcctgagagacagaactgttcaggacactttaaaaaccctcatgaatgctgtcagtcccctaaaaagtattgtcgcaaattcaaataaaatttatttttccgccattgccaaaacacagaagatttggactgcgtatctcgaggctataatgaaggttgggcagatgcagattctgagacaacagattgccaatgaattaaattattcttgtcggtttgattctaaacatctggcagctgctctggagaatctcaataaggctctcctagcagacattgaagcccactatcaggacccttcacttccttaccccaaagaagataacacacttttatatgaaatcacagcctatctggaggcagctggcattcacaacccactgaataagatatacataacaacaaagcgcttaccctattttccaattgtaaactttctatttttgatcgctcagttgccaaaacttcaatacaacaaaaatctgggaatggtctgccgaaaaccgaccgacccggttgattggccaccacttgtcctgggactgctcactctgctgaagcagttccattcccggtacaccgagcagttcctggcgctgattggccagtttatctgctccacggtggagcagtgtacaagccagaagatacctgaaattcctgcagatgttgtgggtgcccttctgttcctggaggattatgttcggtacacaaagctacccaggagggttgctgaagcacatgtgcctaatttcatttttgatgagttcagaacagtgctgtaa

SEQ ID NO: 19 - protein, 1524 aa, Homosapien
MPENPATDKLQVLQVLDRLKMKLQEKGDTSQNEKLSMFYETLKSPLFNQILTLQQSIKQLKGQLNHIPSDCSANFDFSRKGLLVFTDGSITNGNVHRPSNNSTVSGLFPWTPKLGNEDFNSVIQQMAQGRQIEYIDIERPSTGGLGFSVVALRSQNLGKVDIFVKDVQPGSVADRDQRLKENDQILAINHTPLDQNISHQQAIALLQQTTGSLRLIVAREPVHTKSSTSSSLNDTTLPETVCWGHVEEVELINDGSGLGFGIVGGKTSGVVVRTIVPGGLADRDGRLQTGDHILKIGGTNVQGMTSEQVAQVLRNCGNSVRMLVARDPAGDISVTPPAPAALPVALPTVASKGPGSDSSLFETYNVELVRKDGQSLGIRIVGYVGTSHTGEASGIYVKSIIPGSAAYHNGHIQVNDKIVAVDGVNIQGFANHDVVEVLRNAGQVVHLTLVRRKTSSSTSPLEPPSDRGTVVEPLKPPALFLTGAVETETNVDGEDEEIKERIDTLKNDNIQALEKLEKVPDSPENELKSRWENLLGPDYEVMVATLDTQIADDAELQKYSKLLPIHTLRLGVEVDSFDGHHYISSIVSGGPVDTLGLLQPEDELLEVNGMQLYGKSRREAVSFLKEVPPPFTLVCCRRLFDDEASVDEPRRTETSLPETEVDHNMDVNTEEDDDGELALWSPEVKIVELVKDCKGLGFSILDYQDPLDPTRSVIVIRSLVADGVAERSGGLLPGDRLVSVNEYCLDNTSLAEAVEILKAVPPGLVHLGICKPLVEDNEEESCYILHSSSNEDKTEFSGTIHDINSSLILEAPKGFRDEPYFKEELVDEPFLDLGKSFHSQQKEIEQSKEAWEMHEFLTPRLQEMDEEREMLVDEEYELYQDPSPSMELYPLSHIQEATPVPSVNELHFGTQWLHDNEPSESQEARTGRTVYSQEAQPYGYCPENVMKENFVMESLPSVPSTEGNSQQGRFDDLENLNSLAKTSLDLGMIPNDVQGPSLLIDLPVVAQRREQEDLPLYQHQATRVISKASAYTGMLSSRYATDTCELPEREEGEGEETPNFSHWGPPRIVEIFREPNVSLGISIVGGQTVIKRLKNGEELKGIFIKQVLEDSPAGKTNALKTGDKILEVSGVDLQNASHSEAVEAIKNAGNPVVFIVQSLSSTPRVIPNVHNKANKITGNQNQDTQEKKEKRQGTAPPPMKLPPPYKALTDDSDENEEEDAFTDQKIRQRYADLPGELHIIELEKDKNGLGLSLAGNKDRSRMSIFVVGINPEGPAAADGRMRIGDELLEINNQILYGRSHQNASAIIKTAPSKVKLVFIRNEDAVNQMAVTPFPVPSSSPSSIEDQSGTEPISSEEDGSVEVGIKQLPESESFKLAVSQMKQQKYPTKVSFSSQEIPLAPASSYHSTDADFTGYGGFQAPLSVDPATCPIVPGQEMIIEISKGRSGLGLSIVGGKDTPLVNGVDLRNSSHEEAITALRQTPQKVRLVVYRDEAHYRDEENLEIFPVDLQKKAGRGLGLSIVGKR

SEQ ID NO: 20 - DNA, 4575 bp, Homosapien
atgcctgaaaatcctgctacagataaactgcaggtgctgcaggtacttgatcgcctgaaaatgaaattgcaggagaagggtgacacgtcgcagaatgagaagttatctatgttttatgagacactaaagagtcctctcttcaaccagatactcacacttcagcagtccatcaagcaactgaagggtcaactcaaccatataccctcagattgttcagccaactttgatttttctaggaaaggtttgttagtgttcacagatggttccattactaatggaaatgtccacaggccctctaataactcgactgtatctgggttatttccgtggaccccgaagttgggaaatgaagactttaactcagtcattcaacagatggctcagggccggcaaattgaatatatagatatagaacggccttcaactggaggccttggattcagtgtggtggccctcagaagtcaaaatctcggaaaagttgatatcttcgtgaaggatgtccagccagggagtgtagcagacagggatcaaagattaaaggaaaatgatcaaatattggccattaatcacacgccattggatcagaacatttcccatcagcaagcaattgcattattacaacaaaccactggatctttgagactgattgtggccagggaaccagtccacacaaaaagcagtacttctagcagcctaaatgatacaactctgcctgaaacagtttgttggggccatgttgaagaggttgagctcattaatgatggctctggactaggttttggaatagttggaggaaaaacaagtggcgtggttgtgaggactatagttcctggaggattagcagatcgagatggaagactccagacaggggaccacatcttgaagattggtggcacaaacgtgcagggaatgaccagtgagcaagttgcacaagttctaaggaactgtgggaattcagtcaggatgctcgttgctagagatccagctggtgacatttcagtcaccccccctgcccctgcagccttacctgttgccctgcctactgtagccagcaagggccctggttctgacagttctctttttgaaacttataatgttgagcttgtgagaaaagatgggcagagtcttggaattagaattgttggctatgttggaacatctcatacaggggaagcttcagggatttatgtgaaaagtataatacctggcagtgctgcgtaccacaatggccacattcaagtgaatgacaaaatagttgctgtcgatggcgtgaacattcagggttttgccaaccatgatgttgttgaagtattacgaaatgcagggcaggtggtacacctaaccctagttcgaaggaagacatcctcatctacttctccacttgaaccaccttcagacagaggaactgttgtagaaccactgaaaccaccagctctctttctaactggagcagtggaaactgaaactaatgtggatggtgaagatgaggaaattaaagaaagaattgatactttaaaaaatgacaacatacaagccttagaaaaattggaaaaagtcccagactctccagaaaatgagctgaaatccagatgggaaaacctgttgggtcctgattatgaagtaatggttgctactttggacacacagattgcagatgatgctgagttacagaaatattcaaagctgctgcctattcacactctgaggcttggtgtggaagtggattcctttgatgggcaccattatatttcttcaattgtttctggtggtcctgttgatacattgggtctcctacagccagaagatgagctgcttgaggtcaatggcatgcagctttatggaaaatctcgccgagaagcagtctcctttcttaaagaagtgccacccccttttactttggtttgctgtcggaggttgtttgatgatgaagcttctgtagatgaaccaaggcgcactgaaacctctcttcctgagacagaggttgaccacaatatggatgtcaatactgaagaagatgatgatggggaattagcactgtggtcccctgaagtcaagattgttgaactagtaaaagattgtaaaggtttgggattcagcattttggattaccaggaccctttagatcctacaagatcagtgattgtgatccgctccctggtagcagatggtgtagcagaaagaagtgggggactattacctggagaccgcctggtctcagtcaatgaatactgtttggacaacacctcacttgctgaagctgtggaaatattgaaagctgtgccaccaggcctagtacaccttggcatctgtaagcctttggtggaagataatgaagaagaaagttgttatattttacattcaagcagtaatgaagacaagactgaattttcaggaacaattcatgatataaattcatctttaatactcgaagcacccaagggatttagagatgaaccatattttaaagaagaacttgtggatgaaccatttctagatctgggaaagtctttccattcccaacaaaaagagatagagcaaagcaaggaggcctgggagatgcatgaatttctgactcctagattgcaggaaatggatgaagaaagagaaatgcttgttgatgaagaatatgagttatatcaagatccctcaccatccatggagttgtatcccttgtcgcacattcaagaggccactcctgtgccctctgtgaatgaacttcactttggtacacagtggttgcatgataatgaaccatccgagtctcaagaggcaagaaccgggaggactgtctattcccaggaggcacagccgtatggctattgccctgaaaatgtgatgaaagaaaattttgtcatggagtccctaccatctgtaccatcaactgaaggaaacagtcaacaaggcagatttgacgacctggaaaatcttaattcattagcaaaaactagtctggatttaggcatgatcccgaatgatgtccaaggtcctagcttgctcattgaccttcctgttgtggctcaaaggagggagcaagaagatttgcctttatatcaacaccaagcgacacgagttatttccaaggcctcagcatacacaggaatgttgtcttctagatatgccactgatacatgtgagttacctgagagagaagaaggcgaaggagaagaaactccaaattttagccactggggtccaccgagaattgttgagatttttagagaacccaatgtgtctcttgggatcagtattgttggtggacaaactgttataaaacgtctaaagaatggagaggagcttaaaggtatattcatcaaacaagttttagaagacagtccagcagggaagacgaacgcacttaaaactggagataaaatacttgaggtgtctggagtagatttgcagaatgcctcacacagcgaagcagttgaggccattaagaatgcaggaaaccctgtggtgttcattgttcagagtttgtcatccactccacgagtcattcctaacgtacataacaaggccaacaaaatcaccggtaaccagaaccaggacacccaagaaaagaaagaaaagaggcaaggaactgctccaccgccaatgaaacttcctcctccttataaagctctgactgatgacagtgatgaaaatgaagaagaagatgcctttaccgaccaaaaaatcagacaaagatatgcagatctgcctggagaactgcacattattgaacttgaaaaagataagaatggacttggactcagccttgctggtaataaagaccgatcacgcatgagcatatttgtggtgggaattaacccggaaggacctgctgccgcagatggacgaatgcgtattggagatgaactcttagagataaacaatcagattctgtatggaagaagtcaccaaaatgcatctgccattattaagactgccccatcaaaggtcaagctggttttcatcagaaacgaggatgcagtcaatcagatggccgttactccctttccagtgccatcaagttctccatcttctattgaggatcagagcggcaccgaacctattagtagtgaggaagatggcagcgtcgaagttggtattaaacaattgcctgaaagtgaaagcttcaaactggctgtcagccagatgaaacagcaaaaatatccaacaaaagtctccttcagttcacaagagataccattagcaccagcttcatcataccattcaacagatgcagacttcacaggctatggtggtttccaggctcctctgtcagtggaccccgcaacgtgtcccattgtccctggacaggaaatgattatagaaatatccaagggacgttcagggcttggtctcagcattgtgggaggaaaagacacacccttggttaatggggttgacctgaggaactccagccacgaagaagccatcacagccctgaggcagaccccccagaaggtgcggctggtggtgtatagagatgaggcacactaccgggatgaggagaacttggagattttccctgtggatctgcagaagaaagctggccggggcctgggcctgagcatcgttgggaaacggtaa

SEQ ID NO: 21 - protein, 2363 aa, Homosapien
MAAVLQQVLERTELNKLPKSVQNKLEKFLADQQSEIDGLKGRHEKFKVESEQQYFEIEKRLSHSQERLVNETRECQSLRLELEKLNNQLKALTEKNKELEIAQDRNIAIQSQFTRTKEELEAEKRDLIRTNERLSQELEYLTEDVKRLNEKLKESNTTKGELQLKLDELQASDVSVKYREKRLEQEKELLHSQNTWLNTELKTKTDELLALGREKGNEILELKCNLENKKEEVSRLEEQMNGLKTSNEHLQKHVEDLLTKLKEAKEQQASMEEKFHNELNAHIKLSNLYKSAADDSEAKSNELTRAVEELHKLLKEAGEANKAIQDHLLEVEQSKDQMEKEMLEKIGRLEKELENANDLLSATKRKGAILSEEELAAMSPTAAAVAKIVKPGMKLTELYNAYVETQDQLLLEKLENKRINKYLDEIVKEVEAKAPILKRQREEYERAQKAVASLSVKLEQAMKEIQRLQEDTDKANKQSSVLERDNRRMEIQVKDLSQQIRVLLMELEEARGNHVIRDEEVSSADISSSSEVISQHLVSYRNIEELQQQNQRLLVALRELGETREREEQETTSSKITELQLKLESALTELEQLRKSRQHQMQLVDSIVRQRDMYRILLSQTTGVAIPLHASSLDDVSLASTPKRPSTSQTVSTPAPVPVIESTEAIEAKAALKQLQEIFENYKKEKAENEKIQNEQLEKLQEQVTDLRSQNTKISTQLDFASKRYEMLQDNVEGYRREITSLHERNQKLTATTQKQEQIINTMTQDLRGANEKLAVAEVRAENLKKEKEMLKLSEVRLSQQRESLLAEQRGQNLLLTNLQTIQGILERSETETKQRLSSQIEKLEHEISHLKKKLENEVEQRHTLTRNLDVQLLDTKRQLDTETNLHLNTKELLKNAQKEIATLKQHLSNMEVQVASQSSQRTGKGQPSNKEDVDDLVSQLRQTEEQVNDLKERLKTSTSNVEQYQAMVTSLEESLNKEKQVTEEVRKNIEVRLKESAEFQTQLEKKLMEVEKEKQELQDDKRRAIESMEQQLSELKKTLSSVQNEVQEALQRASTALSNEQQARRDCQEQAKIAVEAQNKYERELMLHAADVEALQAAKEQVSKMASVRQHLEETTQKAESQLLECKASWEERERMLKDEVSKCVCRCEDLEKQNRLLHDQIEKLSDKVVASVKEGVQGPLNVSLSEEGKSQEQILEILRFIRREKEIAETRFEVAQVESLRYRQRVELLERELQELQDSLNAEREKVQVTAKTMAQHEELMKKTETMNVVMETNKMLREEKERLEQDLQQMQAKVRKLELDILPLQEANAELSEKSGMLQAEKKLLEEDVKRWKARNQHLVSQQKDPDTEEYRKLLSEKEVHTKRIQQLTEEIGRLKAEIARSNASLTNNQNLIQSLKEDLNKVRTEKETIQKDLDAKIIDIQEKVKTITQVKKIGRRYKTQYEELKAQQDKVMETSAQSSGDHQEQHVSVQEMQELKETLNQAETKSKSLESQVENLQKTLSEKETEARNLQEQTVQLQSELSRLRQDLQDRTTQEEQLRQQITEKEEKTRKAIVAAKSKIAHLAGVKDQLTKENEELKQRNGALDQQKDELDVRITALKSQYEGRISRLERELREHQERHLEQRDEPQEPSNKVPEQQRQITLKTTPASGERGIASTSDPPTANIKPTPVVSTPSKVTAAAMAGNKSTPRASIRPMVTPATVTNPTTTPTATVMPTTQVESQEAMQSEGPVEHVPVFGSTSGSVRSTSPNVQPSISQPILTVQQQTQATAFVQPTQQSHPQIEPANQELSSNIVEVVQSSPVERPSTSTAVFGTVSATPSSSLPKRTREEEEDSTIEASDQVSDDTVEMPLPKKLKSVTPVGTEEEVMAEESTDGEVETQVYNQDSQDSIGEGVTQGDYTPMEDSEETSQSLQIDLGPLQSDQQTTTSSQDGQGKGDDVIVIDSDDEEEDDDENDGEHEDYEEDEEDDDDDEDDTGMGDEGEDSNEGTGSADGNDGYEADDAEGGDGTDPGTETEESMGGGEGNHRAADSQNSGEGNTGAAESSFSQEVSREQQPSSASERQAPRAPQSPRRPPHPLPPRLTIHAPPQELGPPVQRIQMTRRQSVGRGLQLTPGIGGMQQHFFDDEDRTVPSTPTLVVPHRTDGFAEAIHSPQVAGVPRFRFGPPEDMPQTSSSHSDLGQLASQGGLGMYETPLFLAHEEESGGRSVPTTPLQVAAPVTVFTESTTSDASEHASQSVPMVTTSTGTLSTTNETATGDDGDEVFVEAESEGISSEAGLEIDSQQEEEPVQASDESDLPSTSQDPPSSSSVDTSSSQPKPFRRVRLQTTLRQGVRGRQFNRQRGVSHAMGGRGGINRGNIN

SEQ ID NO: 22 - DNA, 7092 bp, Homosapien
atggcggcggtgttgcagcaagtcctggagcgcacggagctgaacaagctgcccaagtctgtccagaacaaacttgaaaagttccttgctgatcagcaatccgagatcgatggcctgaaggggcggcatgagaaatttaaggtggagagcgaacaacagtattttgaaatagaaaagaggttgtcccacagtcaggagagacttgtgaatgaaacccgagagtgtcaaagcttgcggcttgagctagagaaactcaacaatcaactgaaggcactaactgagaaaaacaaagaacttgaaattgctcaggatcgcaatattgccattcagagccaatttacaagaacaaaggaagaattagaagctgagaaaagagacttaattagaaccaatgagagactatctcaagaacttgaatacttaacagaggatgttaaacgtctgaatgaaaaacttaaagaaagcaatacaacaaagggtgaacttcagttaaaattggatgaacttcaagcttctgatgtttctgttaagtatcgagaaaaacgcttggagcaagaaaaggaattgctacatagtcagaatacatggctgaatacagagttgaaaaccaaaactgatgaacttctggctcttggaagagaaaaagggaatgagattctagagcttaaatgtaatcttgaaaataaaaaagaagaggtttctagactggaagaacaaatgaatggcttaaaaacatcaaatgaacatcttcaaaagcatgtggaggatctgttgaccaaattaaaagaggccaaggaacaacaggccagtatggaagagaaattccacaatgaattaaatgcccacataaaactttctaatttgtacaagagtgccgctgatgactcagaagcaaagagcaatgaactaacccgggcagtagaggaactacacaaacttttgaaagaagctggtgaagccaacaaagcaatacaagatcatcttctagaggtggagcaatccaaagatcaaatggaaaaagaaatgcttgagaaaatagggagattggagaaggaattagagaatgcaaatgaccttctttctgccacaaaacgtaaaggagccatattgtctgaagaagagcttgccgccatgtctcctactgcagcagctgtagctaagatagtgaaacctgggatgaaactaactgagctctataatgcttatgtggaaactcaggatcagttgcttttggagaaactagagaacaaaagaattaataagtacctagatgaaatagtgaaagaagtggaagccaaagcaccaattttgaaacgccagcgtgaggaatatgaacgtgcacagaaagctgtagcaagtttatctgttaagcttgaacaagctatgaaggagattcagcgattgcaggaggacactgataaagccaacaagcaatcatctgtacttgagagagataatcgaagaatggaaatacaagtaaaagatctttcacaacagattagagtgcttttgatggaacttgaagaagcaaggggtaaccacgtaattcgtgatgaggaagtaagctctgctgatataagtagttcatctgaggtaatatcacagcatctagtatcttacagaaatattgaagagcttcaacaacaaaatcaacgtctcttagtggcccttagagagcttggggaaaccagagaaagagaagaacaagaaacaacttcatccaaaatcactgagcttcagctcaaacttgagagtgcccttactgaactagaacaactccgcaaatcacgacagcatcaaatgcagcttgttgattccatagttcgtcagcgtgatatgtaccgtattttattgtcacaaacaacaggagttgccattccattacatgcttcaagcttagatgatgtttctcttgcatcaactccaaaacgtccaagtacatcacagactgtttccactcctgctccagtacctgttattgaatcaacagaggctatagaggctaaggctgcccttaaacagttgcaggaaatttttgagaactacaaaaaagaaaaagcagaaaatgaaaaaatacaaaatgagcagcttgagaaacttcaagaacaagttacagatttgcgatcacaaaataccaaaatttctacccagctagattttgcttctaaacgttatgaaatgctgcaagataatgttgaaggatatcgtcgagaaataacatcacttcatgagagaaatcagaaactcactgccacaactcaaaagcaagaacagattatcaatacgatgactcaagatttgagaggagcaaatgagaagctagctgtcgcagaagtaagagcagaaaatttgaagaaggaaaaggaaatgcttaaattgtctgaagttcgtctttctcagcaaagagagtctttgttagctgaacaaagggggcaaaacttactgctaactaatctgcaaacaattcagggaatactggagcgatctgaaacagaaaccaaacaaaggcttagtagccagatagaaaaactggaacatgagatctctcatctaaagaagaagttggaaaatgaggtggaacaaaggcatacacttactagaaatctagatgttcaacttttagatacaaagagacaactggatacagagacaaatcttcatcttaacacaaaagaactattaaaaaatgctcaaaaagaaattgccacattgaaacagcacctcagtaatatggaagtccaagttgcttctcagtcttcacagagaactggtaaaggtcagcctagcaacaaagaagatgtggatgatcttgtgagtcagctaagacagacagaagagcaggtgaatgacttaaaggagagactcaaaacaagtacgagcaatgtggaacaatatcaagcaatggttactagtttagaagaatccctgaacaaggaaaaacaggtgacagaagaagtgcgtaagaatattgaagttcgtttaaaagagtcagctgaatttcagacacagttggaaaagaagttgatggaagtagagaaggaaaaacaagaacttcaggatgataaaagaagagccatagagagcatggaacaacagttatctgaattgaagaaaacactttctagtgttcagaatgaagtacaagaagctcttcagagagcaagcacagctttaagtaatgagcagcaagccagacgtgactgtcaggaacaagctaaaatagctgtggaagctcagaataagtatgagagagaattgatgctgcatgctgctgatgttgaagctctacaagctgcgaaggagcaggtttcaaaaatggcatcagtccgtcagcatttggaagaaacaacacagaaagcagaatcacagttgttggagtgtaaagcatcttgggaggaaagagagagaatgttaaaggatgaagtttccaaatgtgtatgtcgctgtgaagatctggagaaacaaaacagattacttcatgatcagatcgaaaaattaagtgacaaggtcgttgcctctgtgaaggaaggtgtacaaggtccactgaatgtatctctcagtgaagaaggaaaatctcaagaacaaattttggaaattctcagatttatacgacgagaaaaagaaattgctgaaactaggtttgaggtggctcaggttgagagtctgcgttatcgacaaagggttgaacttttagaaagagagctgcaggaactgcaagatagtctaaatgctgaaagggagaaagtccaggtaactgcaaaaacaatggctcagcatgaagaactgatgaagaaaactgaaacaatgaatgtagttatggagaccaataaaatgctaagagaagagaaggagagactagaacaggatctacagcaaatgcaagcaaaggtgaggaaactggagttagatattttacccttacaagaagcaaatgctgagctgagtgagaaaagcggtatgttgcaggcagagaagaagctcttagaagaggatgtcaaacgttggaaagcacgtaaccagcatctagtaagtcaacagaaagatccagatacagaagaatatcggaagctcctttctgaaaaggaagttcatactaagcgtattcaacaattgacagaagaaattggtagacttaaagctgaaattgcaagatcaaatgcatctttgactaacaaccagaacttaattcagagtctgaaggaagatctaaataaagtaagaactgaaaaggaaaccatccagaaggacttagatgccaaaataattgatatccaagaaaaagtcaaaactattactcaagttaagaaaattggacgtaggtacaagactcaatatgaagaacttaaagcacaacaggataaggttatggagacatcggctcagtcctctggagaccatcaggagcagcatgtttcagtccaggaaatgcaggaactcaaagaaacgctcaaccaagctgaaacaaaatcaaaatcacttgaaagtcaagtagagaatctgcagaagacattatctgaaaaagagacagaagcaagaaatctccaggaacagactgtgcaacttcagtctgaactttcacgacttcgtcaggatcttcaagatagaaccacacaggaggagcagctccgacaacagataactgaaaaggaagaaaaaaccagaaaggctattgtagcagcaaagtcaaaaattgcacacttagctggtgtaaaagatcagctaactaaagaaaatgaggagcttaaacaaaggaatggagccttagatcagcagaaagatgaattggatgttcgcattactgcgctaaagtcccaatatgaaggtcgaattagtcgcttggaaagagaactcagggagcatcaagagagacaccttgagcagagagatgagcctcaagaaccttctaataaggtccctgaacagcagagacagatcacattgaaaacaactccagcttctggtgaaagaggaattgccagcacatcagacccaccaacagccaatatcaagccaactcctgttgtgtctactccaagtaaagtgacagctgcagctatggctggaaataagtcaacacccagggctagtatccgcccaatggttacacctgcaactgttacaaatcccactactaccccaacagctacagtgatgcccactacacaagtggaatcacaggaagctatgcagtcagaagggcctgtggaacatgttccagtttttggaagcacaagtggatccgttcgttctactagtcctaatgtccagccttctatctctcaacctattttaactgttcagcaacaaacacaggctacagcttttgtgcaacccactcaacagagtcatcctcagattgagcctgccaatcaagagttatcttcaaacatagtagaggttgttcagagttcaccagttgagcggccttctacttccacagcagtatttggcacagtttcggctacccccagttcttctttgccaaagcgtacacgtgaagaggaagaggatagcaccatagaagcatcagaccaagtctctgatgatacagtggaaatgcctcttccaaagaagttgaaaagtgtcacacctgtaggaactgaggaagaagttatggcagaagaaagtactgatggagaggtagagactcaggtatacaaccaggattctcaagattccattggagaaggagttacccagggagattatacacctatggaagacagtgaagaaacctctcagtctctacaaatagatcttgggccacttcaatcagatcagcagacgacaacttcatcccaggatggtcaaggcaaaggagatgatgtcattgtaattgacagtgatgatgaagaagaggatgatgatgaaaatgatggagaacatgaggattatgaagaggatgaggaagatgatgatgatgatgaagatgacacagggatgggagatgagggtgaagatagtaatgaaggaactggtagtgccgatggcaatgatggttatgaagctgatgatgctgagggtggtgatgggactgatccaggtacagaaacagaagaaagtatgggtggaggtgaaggtaatcacagagctgctgattctcaaaacagtggtgaaggaaatacaggtgctgcagaatcttctttttctcaggaggtttctagagaacaacagccatcatcagcatctgaaagacaggcccctcgagcacctcagtcaccgagacgcccaccacatccacttcccccaagactgaccattcatgccccacctcaggagttgggaccaccagttcagagaattcagatgacccgaaggcagtctgtaggacgtggccttcagttgactccaggaataggtggcatgcaacagcatttttttgatgatgaagacagaacagttccaagtactccaactcttgtggtgccacatcgtactgatggatttgctgaagcaattcattcgccgcaggttgctggtgtccctagattccggtttgggccacctgaagatatgccacaaacaagttctagtcactctgatcttggccagcttgcttctcaaggaggtttaggaatgtatgaaacacccctgttcctagctcatgaagaagagtcaggtggccgaagtgttcccactactccactacaagtagcagccccagtgactgtatttactgagagcaccacctctgatgcttcggaacatgcctctcaatctgttccaatggtgactacatccactggcactttatctacaacaaatgaaacagcaacaggtgatgatggagatgaagtatttgtggaggcagaatctgaaggtattagttcagaagcaggcctagaaattgatagccagcaggaagaagagccggttcaagcatctgatgagtcagatctcccctccaccagccaggatcctccttctagctcatctgtagatactagtagtagtcaaccaaagcctttcagacgagtaagacttcagacaacattgagacaaggtgtccgtggtcgtcagtttaacagacagagaggtgtgagccatgcaatgggagggagaggaggaataaacagaggaaatattaattaa

SEQ ID NO: 23 - protein, 479 aa, Homosapien
MVGRSRRRGAAKWAAVRAKAGPTLTDENGDDLGLPPSPGDTSYYQDQVDDFHEARSRAALAKGWNEVQSGDEEDGEEEEEEVLALDMDDEDDEDGGNAGEEEEEENADDDGGSSVQSEAEASVDPSLSWGQRKKLYYDTDYGSKSRGRQSQQEAEEEEREEEEEAQIIQRRLAQALQEDDFGVAWVEAFAKPVPQVDEAETRVVKDLAKVSVKEKLKMLRKESPELLELIEDLKVKLTEVKDELEPLLELVEQGIIPPGKGSQYLRTKYNLYLNYCSNISFYLILKARRVPAHGHPVIERLVTYRNLINKLSVVDQKLSSEIRHLLTLKDDAVKKELIPKAKSTKPKPKSVSKTSAAACAVTDLSDDSDFDEKAKLKYYKEIEDRQKLKRKKEENSTEEQALEDQNAKRAITYQIAKNRGLTPRRKKIDRNPRVKHREKFRRAKIRRRGQVREVRKEEQRYSGELSGIRAGVKKSIKLK

SEQ ID NO: 24 - DNA, 1440 bp, Homosapien
atggtggggagatcccggcggcgcggagcagctaagtgggcagctgtgcgagccaaggcaggtcccacgctcaccgacgaaaatggagatgatttaggattgccaccctcaccaggggacaccagctactaccaagatcaggtagatgactttcatgaggcacgatcccgggccgccttagctaagggctggaatgaagtacagagtggagacgaggaggatggcgaggaggaggaggaggaggtgctagccctagatatggacgatgaggacgacgaagatggagggaatgcgggggaggaggaggaggaggagaatgccgatgatgatggtgggagctccgtgcaaagtgaagctgaggcctctgtggatcccagtttgtcgtggggtcagaggaaaaaactttactatgacacggactatggttccaagtcccgaggccggcagagtcaacaggaggcagaggaggaggaaagagaggaggaggaggaggcacagatcattcagcggcgcctagcccaagcgctgcaagaggatgattttggtgtcgcctgggttgaggcctttgcaaaaccagtgcctcaggtagatgaggctgagacacgggtcgtgaaggatttggctaaagtttcagtgaaagagaagctgaaaatgttgcgaaaggaatcaccagaactcttggagctgatagaagacctgaaagtcaagttgacagaggttaaggatgagctggagccattgttagagttggtggaacaagggatcattccacccggaaaaggaagccaatacttgaggaccaagtacaacctctacttgaattattgctcgaacatcagtttttatttgatcctgaaagctaggagagtcccagcacatggacatcctgtcatagaaaggcttgttacctaccgaaatttgatcaacaagctgtccgttgtggatcagaagctgtcctcagaaattcgtcatctgttgacacttaaggatgatgctgtaaagaaagaactgattccaaaagcaaaatccaccaagcccaaaccaaagtctgtttcaaagacttctgctgctgcctgtgctgttacagatctttctgatgattctgattttgatgaaaaagcaaaactgaagtactataaagaaatagaagacaggcaaaagctaaagagaaagaaagaagaaaatagcactgaagaacaggctcttgaagatcaaaatgcaaagagagctattacctatcaaattgctaaaaataggggacttactcctaggagaaagaagattgatcgcaatcccagagtgaaacacagagagaagttcagaagagccaaaattagaagaagaggccaggttcgtgaagttcgtaaagaagagcaacgttatagtggtgaattatctggcattcgtgcaggagttaaaaagagcattaagcttaaatga

SEQ ID NO: 25 - protein, 328 aa, Homosapien
MAAGIVASRRLRDLLTRRLTGSNYPGLSISLRLTGSSAQEEASGVALGEAPDHSYESLRVTSAQKHVLHVQLNRPNKRNAMNKVFWREMVECFNKISRDADCRAVVISGAGKMFTAGIDLMDMASDILQPKGDDVARISWYLRDIITRYQETFNVIERCPKPVIAAVHGGCIGGGVDLVTACDIRYCAQDAFFQVKEVDVGLAADVGTLQRLPKVIGNQSLVNELAFTARKMMADEALGSGLVSRVFPDKEVMLDAALALAAEISSKSPVAVQSTKVNLLYSRDHSVAESLNYVASWNMSMLQTQDLVKSVQATTENKELKTVTFSKL

SEQ ID NO: 26 - DNA, 987 bp, Homosapien
atggcggcggggatagtggcttctcgcagactccgcgacctactgacccggcgactgacaggctccaactacccgggactcagtattagccttcgcctcactggctcctctgcacaagaggaggcttccggagtagccctcggtgaagccccagaccacagctatgagtcccttcgtgtgacgtctgcgcagaaacatgttctgcatgtccagctcaaccggcccaacaagaggaatgccatgaacaaggtcttctggagagagatggtagagtgcttcaacaagatttcgagagacgctgactgtcgggcggtggtgatctctggtgcaggaaaaatgttcactgcaggtattgacctgatggacatggcttcggacatcctgcagcccaaaggagatgatgtggcccggatcagctggtacctccgtgacatcatcactcgataccaggagaccttcaacgtcatcgagaggtgccccaagcccgtgattgctgccgtccatgggggctgcattggcggaggtgtggaccttgtcaccgcctgtgacatccggtactgtgcccaggatgctttcttccaggtgaaggaggtggacgtgggtttggctgccgatgtaggaacactgcagcgcctgcccaaggtcatcgggaaccagagcctggtcaacgagctggccttcaccgcccgcaagatgatggctgacgaggccctgggcagtgggctggtcagccgggtgttcccagacaaagaggtcatgctggatgctgccttagcgctggcggccgagatttccagcaagagccccgtggcggtgcagagcaccaaggtcaacctgctgtattcccgcgaccattcggtggccgagagcctcaactacgtggcgtcctggaacatgagcatgctgcagacccaagacctcgtgaagtcggtccaggccacgactgagaacaaggaactgaaaaccgtcaccttctccaagctctga

SEQ ID NO: 27 - protein, 646 aa, Homosapien
MSKGPAVGIDLGTTYSCVGVFQHGKVEIIANDQGNRTTPSYVAFTDTERLIGDAAKNQVAMNPTNTVFDAKRLIGRRFDDAVVQSDMKHWPFMVVNDAGRPKVQVEYKGETKSFYPEEVSSMVLTKMKEIAEAYLGKTVTNAVVTVPAYFNDSQRQATKDAGTIAGLNVLRIINEPTAAAIAYGLDKKVGAERNVLIFDLGGGTFDVSILTIEDGIFEVKSTAGDTHLGGEDFDNRMVNHFIAEFKRKHKKDISENKRAVRRLRTACERAKRTLSSSTQASIEIDSLYEGIDFYTSITRARFEELNADLFRGTLDPVEKALRDAKLDKSQIHDIVLVGGSTRIPKIQKLLQDFFNGKELNKSINPDEAVAYGAAVQAAILSGDKSENVQDLLLLDVTPLSLGIETAGGVMTVLIKRNTTIPTKQTQTFTTYSDNQPGVLIQVYEGERAMTKDNNLLGKFELTGIPPAPRGVPQIEVTFDIDANGILNVSAVDKSTGKENKITITNDKGRLSKEDIERMVQEAEKYKAEDEKQRDKVSSKNSLESYAFNMKATVEDEKLQGKINDEDKQKILDKCNEIINWLDKNQTAEKEEFEHQQKELEKVCNPIITKLYQSAGGMPGGMPGGFPGGGAPPSGGASSGPTIEEVD

SEQ ID NO: 28 - DNA, 1941 bp, Homosapien
atgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtcttctatggttctgacaaagatgaaggaaattgcagaagcctaccttgggaagactgttaccaatgctgtggtcacagtgccagcttactttaatgactctcagcgtcaggctaccaaagatgctggaactattgctggtctcaatgtacttagaattattaatgagccaactgctgctgctattgcttacggcttagacaaaaaggttggagcagaaagaaacgtgctcatctttgacctgggaggtggcacttttgatgtgtcaatcctcactattgaggatggaatctttgaggtcaagtctacagctggagacacccacttgggtggagaagattttgacaaccgaatggtcaaccattttattgctgagtttaagcgcaagcataagaaggacatcagtgagaacaagagagctgtaagacgcctccgtactgcttgtgaacgtgctaagcgtaccctctcttccagcacccaggccagtattgagatcgattctctctatgaaggaatcgacttctatacctccattacccgtgcccgatttgaagaactgaatgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaaccctgatgaagctgttgcttatggtgcagctgtccaggcagccatcttgtctggagacaagtctgagaatgttcaagatttgctgctcttggatgtcactcctctttcccttggtattgaaactgctggtggagtcatgactgtcctcatcaagcgtaataccaccattcctaccaagcagacacagaccttcactacctattctgacaaccagcctggtgtgcttattcaggtttatgaaggcgagcgtgccatgacaaaggataacaacctgcttggcaagtttgaactcacaggcatacctcctgcaccccgaggtgttcctcagattgaagtcacttttgacattgatgccaatggtatactcaatgtctctgctgtggacaagagtacgggaaaagagaacaagattactatcactaatgacaagggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcagactgctgagaaggaagaatttgaacatcaacagaaagagctggagaaagtttgcaaccccatcatcaccaagctgtaccagagtgcaggaggcatgccaggaggaatgcctgggggatttcctggtggtggagctcctccctctggtggtgcttcctcagggcccaccattgaagaggttgattaa

SEQ ID NO: 29 - protein, 750 aa, Homosapien
MLRAKNQLFLLSPHYLRQVKESSGSRLIQQRLLHQQQPLHPEWAALAKKQLKGKNPEDLIWHTPEGISIKPLYSKRDTMDLPEELPGVKPFTRGPYPTMYTFRPWTIRQYAGFSTVEESNKFYKDNIKAGQQGLSVAFDLATHRGYDSDNPRVRGDVGMAGVAIDTVEDTKILFDGIPLEKMSVSMTMNGAVIPVLANFIVTGEEQGVPKEKLTGTIQNDILKEFMVRNTYIFPPEPSMKIIADIFEYTAKHMPKFNSISISGYHMQEAGADAILELAYTLADGLEYSRTGLQAGLTIDEFAPRLSFFWGIGMNFYMEIAKMRAGRRLWAHLIEKMFQPKNSKSLLLRAHCQTSGWSLTEQDPYNNIVRTAIEAMAAVFGGTQSLHTNSFDEALGLPTVKSARIARNTQIIIQEESGIPKVADPWGGSYMMECLTNDVYDAALKLINEIEEMGGMAKAVAEGIPKLRIEECAARRQARIDSGSEVIVGVNKYQLEKEDAVEVLAIDNTSVRNRQIEKLKKIKSSRDQALAEHCLAALTECAASGDGNILALAVDASRARCTVGEITDALKKVFGEHKANDRMVSGAYRQEFGESKEITSAIKRVHKFMEREGRRPRLLVAKMGQDGHDRGAKVIATGFADLGFDVDIGPLFQTPREVAQQAVDADVHAVGVSTLAAGHKTLVPELIKELNSLGRPDILVMCGGVIPPQDYEFLFEVGVSNVFGPGTRIPKAAVQVLDDIEKCLEKKQQSV

SEQ ID NO: 30 - DNA, 2253 bp, Homosapien
atgttaagagctaagaatcagctttttttactttcacctcattacctgaggcaggtaaaagaatcatcaggctccaggctcatacagcaacgacttctacaccagcaacagccccttcacccagaatgggctgccctggctaaaaagcagctgaaaggcaaaaacccagaagacctaatatggcacaccccggaagggatctctataaaacccttgtattccaagagagatactatggacttacctgaagaacttccaggagtgaagccattcacacgtggaccatatcctaccatgtatacctttaggccctggaccatccgccagtatgctggttttagtactgtggaagaaagcaataagttctataaggacaacattaaggctggtcagcagggattatcagttgcctttgatctggcgacacatcgtggctatgattcagacaaccctcgagttcgtggtgatgttggaatggctggagttgctattgacactgtggaagataccaaaattctttttgatggaattcctttagaaaaaatgtcagtttccatgactatgaatggagcagttattccagttcttgcaaattttatagtaactggagaagaacaaggtgtacctaaagagaaacttactggtaccatccaaaatgatatactaaaggaatttatggttcgaaatacatacatttttcctccagaaccatccatgaaaattattgctgacatatttgaatatacagcaaagcacatgccaaaatttaattcaatttcaattagtggataccatatgcaggaagcaggggctgatgccattctggagctggcctatactttagcagatggattggagtactctagaactggactccaggctggcctgacaattgatgaatttgcaccaaggttgtctttcttctggggaattggaatgaatttctatatggaaatagcaaagatgagagctggtagaagactctgggctcacttaatagagaaaatgtttcagcctaaaaactcaaaatctcttcttctaagagcacactgtcagacatctggatggtcacttactgagcaggatccctacaataatattgtccgtactgcaatagaagcaatggcagcagtatttggagggactcagtctttgcacacaaattcttttgatgaagctttgggtttgccaactgtgaaaagtgctcgaattgccaggaacacacaaatcatcattcaagaagaatctgggattcccaaagtggctgatccttggggaggttcttacatgatggaatgtctcacaaatgatgtttatgatgctgctttaaagctcattaatgaaattgaagaaatgggtggaatggccaaagctgtagctgagggaatacctaaacttcgaattgaagaatgtgctgcccgaagacaagctagaatagattctggttctgaagtaattgttggagtaaataagtaccagttggaaaaagaagacgctgtagaagttctggcaattgataatacttcagtgcgaaacaggcagattgaaaaacttaagaagatcaaatccagcagggatcaagctttggctgaacattgtcttgctgcactaaccgaatgtgctgctagcggagatggaaatatcctggctcttgcagtggatgcatctcgggcaagatgtacagtgggagaaatcacagatgccctgaaaaaggtatttggtgaacataaagcgaatgatcgaatggtgagtggagcatatcgccaggaatttggagaaagtaaagagataacatctgctatcaagagggttcataaattcatggaacgtgaaggtcgcagacctcgtcttcttgtagcaaaaatgggacaagatggccatgacagaggagcaaaagttattgctacaggatttgctgatcttggttttgatgtggacataggccctcttttccagactcctcgtgaagtggcccagcaggctgtggatgcggatgtgcatgctgtgggcgtaagcaccctcgctgctggtcataaaaccctagttcctgaactcatcaaagaacttaactcccttggacggccagatattcttgtcatgtgtggaggggtgataccacctcaggattatgaatttctgtttgaagttggtgtttccaatgtatttggtcctgggactcgaattccaaaggctgccgttcaggtgcttgatgatattgagaagtgtttggaaaagaagcagcaatctgtataa

SEQ ID NO: 31 - protein, 102 aa, Homosapien
MADDVDQQQTTNTVEEPLDLIRLSLDERIYVKMRNDRELRGRLHAYDQHLNMILGDVEETVTTIEIDEETYEEIYKSTKRNIPMLFVRGDGVVLVAPPLRVG

SEQ ID NO: 32 - DNA, 309 bp, Homosapien
atggcggacgacgtagaccagcaacaaactaccaacactgtagaggagcccctggatcttatcaggctcagcctagatgagcgaatttatgtgaaaatgagaaatgaccgagagcttcgaggcagattacatgcttatgatcaacatttaaatatgatcttgggagatgtggaagaaactgtgactactatagaaattgatgaagaaacatatgaagagatatataaatcaacgaaacggaatattccaatgctctttgtccggggagatggcgttgtcctggttgcccctccactgagagttggctga

SEQ ID NO: 33 - protein, 647 aa, Homosapien
MWRVCARRAQNVAPWAGLEARWTALQEVPGTPRVTSRSGPAPARRNSVTTGYGGVRALCGWTPSSGATPRNRLLLQLLGSPGRRYYSLPPHQKVPLPSLSPTMQAGTIARWEKKEGDKINEGDLIAEVETDKATVGFESLEECYMAKILVAEGTRDVPIGAIICITVGKPEDIEAFKNYTLDSSAAPTPQAAPAPTPAATASPPTPSAQAPGSSYPPHMQVLLPALSPTMTMGTVQRWEKKVGEKLSEGDLLAEIETDKATIGFEVQEEGYLAKILVPEGTRDVPLGTPLCIIVEKEADISAFADYRPTEVTDLKPQVPPPTPPPVAAVPPTPQPLAPTPSAPCPATPAGPKGRVFVSPLAKKLAVEKGIDLTQVKGTGPDGRITKKDIDSFVPSKVAPAPAAVVPPTGPGMAPVPTGVFTDIPISNIRRVIAQRLMQSKQTIPHYYLSIDVNMGEVLLVRKELNKILEGRSKISVNDFIIKASALACLKVPEANSSWMDTVIRQNHVVDVSVAVSTPAGLITPIVFNAHIKGVETIANDVVSLATKAREGKLQPHEFQGGTFTISNLGMFGIKNFSAIINPPQACILAIGASEDKLVPADNEKGFDVASMMSVTLSCDHRVVDGAVGAQWLAEFRKYLEKPITMLL

SEQ ID NO: 34 - DNA, 1944 bp, Homosapien
atgtggcgcgtctgtgcgcgacgggctcagaatgtagccccatgggcgggactcgaggctcggtggacggccttgcaggaggtacccggaactccacgagtgacctcgcgatctggcccggctcccgctcgtcgcaacagcgtgactacagggtatggcggggtccgggcactgtgcggctggacccccagttctggggccacgccgcggaaccgcttactgctgcagcttttggggtcgcccggccgccgctattacagtcttcccccgcatcagaaggttccattgccttctctttcccccacaatgcaggcaggcaccatagcccgttgggaaaaaaaagagggggacaaaatcaatgaaggtgacctaattgcagaggttgaaactgataaagccactgttggatttgagagcctggaggagtgttatatggcaaagatacttgttgctgaaggtaccagggatgttcccatcggagcgatcatctgtatcacagttggcaagcctgaggatattgaggcctttaaaaattatacactggattcctcagcagcacctaccccacaagcggccccagcaccaacccctgctgccactgcttcgccacctacaccttctgctcaggctcctggtagctcatatccccctcacatgcaggtacttcttcctgccctctctcccaccatgaccatgggcacagttcagagatgggaaaaaaaagtgggtgagaagctaagtgaaggagacttactggcagagatagaaactgacaaagccactataggttttgaagtacaggaagaaggttatctggcaaaaatcctggtccctgaaggcacaagagatgtccctctaggaaccccactctgtatcattgtagaaaaagaggcagatatatcagcatttgctgactataggccaaccgaagtaacagatttaaaaccacaagtgccaccacctaccccacccccggtggccgctgttcctccaactccccagcctttagctcctacaccttcagcaccctgcccagctactcctgctggaccaaagggaagggtgtttgttagccctcttgcaaagaagttggcagtagagaaagggattgatcttacacaagtaaaagggacaggaccagatggtagaatcaccaagaaggatatcgactcttttgtgcctagtaaagttgctcctgctccggcagctgttgtgcctcccacaggtcctggaatggcaccagttcctacaggtgtcttcacagatatcccaatcagcaacattcgtcgggttattgcacagcgattaatgcaatcaaagcaaaccatacctcattattacctttctatcgatgtaaatatgggagaagttttgttggtacggaaagaacttaataagatattagaagggagaagcaaaatttctgtcaatgacttcatcataaaagcttcagctttggcatgtttaaaagttcccgaagcaaattcttcttggatggacacagttataagacaaaatcatgttgttgatgtcagtgttgcggtcagtactcctgcaggactcatcacacctattgtgtttaatgcacatataaaaggagtggaaaccattgctaatgatgttgtttctttagcaaccaaagcaagagagggtaaactacagccacatgaattccagggtggcacttttacgatctccaatttaggaatgtttggaattaagaatttctctgctattattaacccacctcaagcatgtattttggcaattggtgcttcagaggataaactggtccctgcagataatgaaaaagggtttgatgtggctagcatgatgtctgttacactcagttgtgatcaccgggtggtggatggagcagttggagcccagtggcttgctgagtttagaaagtaccttgaaaaacctatcactatgttgttgtaa

SEQ ID NO: 35 - protein, 129 aa, Homosapien
MRRRGEIDMATEGDVELELETETSGPERPPEKPRKHDSGAADLERVTDYAEEKEIQSSNLETAMSVIGDRRSREQKAKQEREKELAKVTIKKEDLELIMTEMEISRAAAERSLREHMGNVVEALIALTN

SEQ ID NO: 36 - DNA, 390 bp, Homosapien
atgcggcggcgtggtgaaatagatatggcgaccgagggggatgtggagctggagttggagactgagaccagtggaccagagcggcctccggagaagccacggaaacatgacagcggtgcggcggacttggagcgggtcaccgactatgcagaggagaaggagatccagagttccaatctggagacggccatgtctgtgattggagacagaaggtcccgggagcagaaagccaaacaggagcgggagaaagaactggcaaaagtcactatcaagaaggaagatctggagctaataatgactgagatggagatatctcgagcagcagcagaacgcagtttgcgggaacacatgggcaacgtggtagaggcgcttattgccctaaccaactga

SEQ ID NO: 37 - protein, 152 aa, Homosapien
MANCERTFIAIKPDGVQRGLVGEIIKRFEQKGFRLVGLKFMQASEDLLKEHYVDLKDRPFFAGLVKYMHSGPVVAMVWEGLNVVKTGRVMLGETNPADSKPGTIRGDFCIQVGRNIIHGSDSVESAEKEIGLWFHPEELVDYTSCAQNWIYE

SEQ ID NO: 38 - DNA, 459 bp, Homosapien
atggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaacattatacatggcagtgattctgtggagagtgcagagaaggagatcggcttgtggtttcaccctgaggaactggtagattacacgagctgtgctcagaactggatctatgaatga

SEQ ID NO: 39 - protein, 1261 aa, Homosapien
MFSELSNPESLPAQGQAQNSAQSPASLVLVDAGQQLPPRPPQSSSVSLVSSGSGQAAVPSEQPWPQPVPALAPGPPPQDLAAYYYYRPLYDAYQPQYSLPYPPEPGAASLYYQDVYSLYEPRYRPYDGAASAYAQNYRYPEPERPSSRASHSSERPPPRQGYPEGYYSSKSGWSSQSDYYASYYSSQYDYGDPGHWDRYHYSARVRDPRTYDRRYWCDAEYDAYRREHSAFGDRPEKRDNNWRYDPRFTGSFDDDPDPHRDPYGEEVDRRSVHSEHSARSLHSAHSLASRRSSLSSHSHQSQIYRSHNVAAGSYEAPLPPGSFHGDFAYGTYRSNFSSGPGFPEYGYPADTVWPAMEQVSSRPTSPEKFSVPHVCARFGPGGQLIKVIPNLPSEGQPALVEVHSMEALLQHTSEQEEMRAFPGPLAKDDTHKVDVINFAQNKAMKCLQNENLIDKESASLLWNFIVLLCRQNGTVVGTDIAELLLRDHRTVWLPGKSPNEANLIDFTNEAVEQVEEEESGEAQLSFLTGGPAAAASSLERETERFRELLLYGRKKDALESAMKNGLWGHALLLASKMDSRTHARVMTRFANSLPINDPLQTVYQLMSGRMPAASTCCGDEKWGDWRPHLAMVLSNLNNNMDVESRTMATMGDTLASRGLLDAAHFCYLMAQAGFGVYTKKTTKLVLIGSNHSLPFLKFATNEAIQRTEAYEYAQSLGAETCPLPSFQVFKFIYSCRLAEMGLATQAFHYCEAIAKSILTQPHLYSPVLISQLVQMASQLRLFDPQLKEKPEEESLAAPTWLVHLQQVERQIKEGAGVWHQDGALPQQCPGTPSSEMEQLDRPGLSQPGALGIANPLLAVPAPSPEHSSPSVRLLPSAPQTLPDGPLASPARVPMFPVPLPPGPLEPGPGCVTPGPALGFLEPSGPGLPPGVPPLQERRHLLQEARSPDPGIVPQEAPVGNSLSELSEENFDGKFANLTPSRTVPDSEAPPGWDRADSGPTQPPLSLSPAPETKRPGQAAKKETKEPKKGESWFFRWLPGKKKTEAYLPDDKNKSIVWDEKKNQWVNLNEPEEEKKAPPPPPTSMPKTVQAAPPALPGPPGAPVNMYSRRAAGTRARYVDVLNPSGTQRSEPALAPADFVAPLAPLPIPSNLFVPTPDAEEPQLPDGTGREGPAAARGLANPEPAPEPKVLSSAASLPGSELPSSRPEGSQGGEAPGDLPAAGGPPSGAMPFYNPAQLAQACATSGSSRLGRIGQRKHLVLN

SEQ ID NO: 40 - DNA, 3786 bp, Homosapien
atgttttcggagctgtcaaatccagaaagtctgcccgcacagggacaggcccagaactcagcacagtcaccagcaagtctggttctggtcgacgcgggtcagcagctgccccctcggcctcctcagtcctctagcgtgtctctggtgtccagtggctccggccaggcagctgtgccgtcagagcagccgtggccacagccagtgcctgcacttgcccccggcccaccgcctcaggacctggccgcctactactactaccggcctttgtacgatgcctaccagcctcagtactctttgccgtacccaccggagcctggcgcagcctccctctattaccaggatgtctacagcctctatgagcctcgatacaggccctatgatggtgctgcgtctgcttacgcccagaactaccgctatcccgagcccgagcggcccagctcccgagccagccactcctcggaacggccacctcccaggcaaggatatcctgaaggatactatagttccaaaagtggatggagcagtcagagcgattactatgcaagctattactccagccagtacgattatggagatccaggtcactgggatcgttaccactacagtgctagagtcagggacccccgcacctatgaccggaggtattggtgtgatgcagagtatgacgcatacaggagagagcactctgccttcggggacaggcccgagaaacgtgacaacaactggaggtacgatcctcgcttcacggggagttttgacgatgaccccgatccgcacagagacccttatggggaagaggtggaccggcgcagcgtccacagcgagcactcggcacggagcctgcacagcgcacacagcctggccagccgccgcagcagcctcagctcccactcgcaccagagtcagatttacagaagccacaatgtggctgccggttcctacgaggccccgcttcctccaggctcctttcacggcgattttgcctacggcacctaccgcagcaatttcagcagtggccccggcttcccagagtatggctaccctgccgacaccgtctggcctgccatggagcaagtttcatcaagaccaacttctcctgaaaaattttcagtgcctcatgtctgtgccaggtttggccctggcggtcagcttatcaaagtgattcccaatctgccttcagaaggacagccggccttggtggaggtccacagcatggaggccttgctgcagcacacgtctgagcaggaggagatgcgggcgttcccgggacccctggccaaagacgacacccataaggtggatgtcattaattttgcacagaacaaagctatgaaatgtttgcagaatgaaaacttaattgacaaagagtctgcaagtcttctttggaattttatcgttctcttatgcagacaaaatgggaccgtggtagggaccgacattgcggagcttctgttacgagaccacagaacagtgtggcttcctgggaagtcgcccaatgaagcaaacctgattgatttcacgaatgaggcagtggagcaggtggaagaggaggagtctggtgaggcccagctctctttcctcactggtggtccggcggctgccgccagctcgctcgagagagagaccgagaggttcagggagctgttgctgtatggccgtaagaaggatgctttggagtctgcaatgaagaatggcctgtggggtcacgctctgctacttgcaagtaagatggacagccggacacacgcccgagtcatgaccaggtttgctaacagcctcccaatcaacgaccctctgcagacagtctaccagctcatgtccggacggatgcctgccgcgtccacgtgctgtggagacgagaaatggggagattggaggccgcacctcgccatggtcttgtccaacttgaacaacaacatggacgtcgagtccaggacgatggctaccatgggcgacactctggcttcaaggggcctcttggatgcggcccacttctgctacctcatggcccaggcgggatttggtgtttacacgaagaaaactacaaagcttgtcttaatcggatccaatcacagtttgccattcttaaagttcgcaaccaacgaagcaatccagaggacggaagcctatgagtacgcccagtccctgggtgccgagacctgccccctgcctagtttccaggtgtttaagttcatctactcctgccgcctggcggaaatggggctggccacgcaagccttccactactgtgaggccatcgcgaagagcatcctgacgcagccgcacctgtattccccggtgttgatcagccagcttgtgcagatggcttcccagttacgactcttcgatccccagctgaaagagaagccagaagaggagtccttggccgcacccacgtggctggttcacctgcagcaggtggagcggcagattaaggagggggctggagtatggcatcaggatggagccctcccgcagcagtgtcctggcactccgagttccgagatggagcagttggacaggccaggactcagtcagccaggagccctggggatcgccaaccctctgctggcggtgcctgcaccgagccctgagcactcgagcccgagcgtgcggctgctgccctcagctccgcagacgctccctgacggcccattggccagtcctgccagagtgccgatgttcccagtgccactgcccccggggcccctggagccgggtcctggctgtgtgaccccagggcctgcacttggcttcctggagccctccgggcctggcctcccacctggtgtgccacctctgcaggaaaggagacacttgctccaggaagccaggagcccagacccagggatagtgccgcaggaggcgcctgttggaaactcactttccgagctaagcgaagaaaattttgatggaaaatttgctaatctgaccccctcgaggacggtgccagactcggaggcccccccagggtgggatcgtgccgactcgggtcccacgcagccacctctgtctctctcacccgctcccgaaacaaagagacccggacaggcagccaagaaagaaacgaaggaacctaagaagggtgaatcctggttctttcgttggctacctggaaagaaaaagacagaagcttatttgccagatgacaagaacaaatcgattgtttgggatgaaaagaaaaaccagtgggtgaatttaaatgagccagaagaggagaagaaagccccgcccccacctccaacctcgatgcccaagactgtgcaagctgccccgcctgccctcccagggcctcctggagcccccgtgaacatgtactctagaagagcagcaggaaccagagctcgctacgttgacgtcctgaacccaagcgggacccagcggagcgagccggctctcgctcctgcggactttgtcgctccactcgcgccactcccaattccttctaacttgttcgtgccaaccccagatgcagaagaaccacagcttccagacgggactggcagggaagggcctgcagcagctaggggcctggccaatccagagcctgccccagagcccaaggttttaagctctgcagcgtcactccctggctctgaactcccctcctccaggcctgagggttcccagggaggagaggctcctggcgacctccctgctgcagggggccctcccagcggggccatgcccttctacaaccctgctcagctggcacaggcctgcgccacctccgggagctcaaggctagggaggattggccagaggaagcacctggtgctgaactag

SEQ ID NO: 41 - protein, 814 aa, Homosapien
MQDAENVAVPEAAEERAEPGQQQPAAEPPPAEGLLRPAGPGAPEAAGTEASSEEVGIAEAGPESEVRTEPAAEAEAASGPSESPSPPAAEELPGSHAEPPVPAQGEAPGEQARDERSDSRAQAVSEDAGGNEGRAAEAEPRALENGDADEPSFSDPEDFVDDVSEEELLGDVLKDRPQEADGIDSVIVVDNVPQVGPDRLEKLKNVIHKIFSKFGKITNDFYPEEDGKTKGYIFLEYASPAHAVDAVKNADGYKLDKQHTFRVNLFTDFDKYMTISDEWDIPEKQPFKDLGNLRYWLEEAECRDQYSVIFESGDRTSIFWNDVKDPVSIEERARWTETYVRWSPKGTYLATFHQRGIALWGGEKFKQIQRFSHQGVQLIDFSPCERYLVTFSPLMDTQDDPQAIIIWDILTGHKKRGFHCESSAHWPIFKWSHDGKFFARMTLDTLSIYETPSMGLLDKKSLKISGIKDFSWSPGGNIIAFWVPEDKDIPARVTLMQLPTRQEIRVRNLFNVVDCKLHWQKNGDYLCVKVDRTPKGTQGVVTNFEIFRMREKQVPVDVVEMKETIIAFAWEPNGSKFAVLHGEAPRISVSFYHVKNNGKIELIKMFDKQQANTIFWSPQGQFVVLAGLRSMNGALAFVDTSDCTVMNIAEHYMASDVEWDPTGRYVVTSVSWWSHKVDNAYWLWTFQGRLLQKNNKDRFCQLLWRPRPPTLLSQEQIKQIKKDLKKYSKIFEQKDRLSQSKASKELVERRRTMMEDFRKYRKMAQELYMEQKNERLELRGGVDTDELDSNVDDWEEETIEFFVTEEIIPLGNQE

SEQ ID NO: 42 - DNA, 2445 bp, Homosapien
atgcaggacgcggagaacgtggcggtgcccgaggcggccgaggagcgcgccgagcccggccagcagcagccggccgccgagccgccgccagccgaggggctgctgcggcccgcggggcccggcgctccggaggccgcggggaccgaggcctccagtgaggaggtggggatcgcggaggccgggccggagtccgaggtgaggaccgagccggcggccgaggcagaggcggcctccggcccgtccgagtcgccctcgccgccggccgccgaggagctgcccgggtcgcatgctgagccccctgtcccggcacagggcgaggccccaggagagcaggctcgggacgagcgctccgacagccgggcccaggcggtgtccgaggacgcgggaggaaacgagggcagagcggccgaggccgaaccccgggcgctggagaacggcgacgcggacgagccctccttcagcgaccccgaggacttcgtggacgacgtgagcgaggaagaattactgggagatgtactcaaagatcggccccaggaagcagatggaatcgattcggtgattgtagtggacaatgtccctcaggtgggacccgaccgacttgagaaactcaaaaatgtcatccacaagatcttttccaagtttgggaaaatcacaaatgatttttatcctgaagaggatgggaagacaaaagggtatattttcctggagtacgcgtcccctgcccacgctgtggatgctgtgaagaacgccgacggctacaagcttgacaagcagcacacattccgggtcaacctctttacggattttgacaagtatatgacgatcagtgacgagtgggatattccagagaaacagcctttcaaagacctggggaacttacgttactggcttgaagaggcagaatgcagagatcagtacagtgtgatttttgagagtggagaccgcacttccatattctggaatgacgtaaaagaccctgtctcaattgaagaaagagcgagatggacagagacgtatgtgcgttggtctcctaagggcacctacctggctacctttcatcaaagaggcattgctctatgggggggagagaaattcaagcaaattcagagattcagccaccaaggggttcagcttattgacttctcaccttgtgaaaggtacctggtgacctttagccccctgatggacacgcaggatgaccctcaggccataatcatctgggacatccttacggggcacaagaagaggggttttcactgtgagagctcagcccattggcctatttttaagtggagccatgatggcaaattctttgccagaatgaccctggatacgcttagcatctatgaaactccttctatgggtcttttggacaagaagagtttgaagatctctgggataaaagacttttcttggtctcctggtggtaacataatcgccttctgggtgcctgaagacaaagatattccagccagggtaaccctgatgcagctccctaccaggcaagagatccgagtgaggaacctgttcaatgtggtggactgcaagctccattggcagaagaacggagactacttgtgtgtgaaagtagataggactccgaaaggcacccagggtgttgtcacaaattttgaaattttccgaatgagggagaaacaggtacctgtggatgtggtcgagatgaaagaaaccatcatagcctttgcctgggaaccaaatggaagtaagtttgctgtgctgcacggagaggctccgcggatatctgtgtctttctaccacgtcaaaaacaacgggaagattgaactcatcaagatgttcgacaagcagcaggcgaacaccatcttctggagcccccaaggacagttcgtggtgttggcgggcctgaggagtatgaacggtgccttagcgtttgtggacacttcggactgcacggtcatgaacatcgcagagcactacatggcttccgacgtcgaatgggatcctactgggcgctacgtcgtcacctctgtgtcctggtggagccataaggtggacaacgcgtactggctgtggactttccagggacgcctcctgcagaagaacaacaaggaccgcttctgccagctgctgtggcggccccggcctcccacactcctgagccaggaacagatcaagcaaattaaaaaggatctgaagaaatactctaagatctttgaacagaaggatcgtttgagtcagtccaaagcctcaaaggaattggtggagagaaggcgcaccatgatggaagatttccggaagtaccggaaaatggcccaggagctctatatggagcagaaaaacgagcgcctggagttgcgaggaggggtggacactgacgagctggacagcaacgtggacgactgggaagaggagaccattgagttcttcgtcactgaagaaatcattcccctcgggaatcaggagtga

SEQ ID NO: 43 - protein, 397 aa, Homosapien
MNAGSDPVVIVSAARTIIGSFNGALAAVPVQDLGSTVIKEVLKRATVAPEDVSEVIFGHVLAAGCGQNPVRQASVGAGIPYSVPAWSCQMICGSGLKAVCLAVQSIGIGDSSIVVAGGMENMSKAPHLAYLRTGVKIGEMPLTDSILCDGLTDAFHNCHMGITAENVATKWQVSREDQDKVAVLSQNRTENAQKAGHFDKEIVPVLVSTRKGLIEVKTDEFPRHGSNIEAMSKLKPYFLTDGTGTVTPANASGINDGAAAVALMKKSEADKRGLTPLARIVSWSQVGVEPSIMGIGPIPAIKQAVTKAGWSLEDVDIFEINEAFAAVSAAIVKELGLNPEKVNIEGGAIALGHPLGASGCRILVTLLHTLERMGRSRGVAALCIGGGMGIAMCVQRE

SEQ ID NO: 44 - DNA, 1194 bp, Homosapien
atgaatgcaggctcagatcctgtggtcatcgtctcggcggcgcggaccatcataggttccttcaatggtgccttagctgctgttcctgtccaggacctgggctccactgtcatcaaagaagtcttgaagagggccactgtggctccggaagatgtgtctgaggtcatctttggacatgtcttggcagcaggctgtgggcagaatcctgttagacaagccagtgtgggtgcaggaattccctactctgttccagcatggagctgccagatgatctgtgggtcaggcctaaaagctgtgtgccttgcagtccagtcaatagggataggagactccagcattgtggttgcaggaggcatggaaaatatgagcaaggctcctcacttggcttacttgagaacaggagtaaagataggtgagatgccactgactgacagtatactctgtgatggtcttacagatgcatttcacaactgtcatatgggtattacagctgaaaatgtagccacaaaatggcaagtgagtagagaagatcaggacaaggttgcagttctgtcccagaacaggacagagaatgcacagaaagctggccattttgacaaagagattgtaccagttttggtgtcaactagaaaaggtcttattgaagttaaaacagatgagtttcctcgccatgggagcaacatagaagccatgtccaagctaaagccttactttcttactgatggaacgggaacagtcaccccagccaatgcttcaggaataaatgatggtgctgcagctgttgctcttatgaagaagtcagaagctgataaacgtgggcttacacctttagcacggatagtttcctggtcccaagtgggtgtggagccttccattatgggaataggaccaattccagccataaagcaagctgttacaaaagcaggttggtcactggaagatgttgacatatttgaaatcaatgaagcctttgcagctgtctctgctgcaatagttaaagaacttggattaaacccagagaaggtcaatattgaaggaggggctatagccttgggccaccctcttggagcatctggctgtcgaattcttgtgaccctgttacacacactggagagaatgggcagaagtcgtggtgttgcagccctgtgcattgggggtgggatgggaatagcaatgtgtgttcagagagaatga

SEQ ID NO: 45 - protein, 908 aa, Homosapien
MEEGGRDKAPVQPQQSPAAAPGGTDEKPSGKERRDAGDKDKEQELSEEDKQLQDELEMLVERLGEKDTSLYRPALEELRRQIRSSTTSMTSVPKPLKFLRPHYGKLKEIYENMAPGENKRFAADIISVLAMTMSGERECLKYRLVGSQEELASWGHEYVRHLAGEVAKEWQELDDAEKVQREPLLTLVKEIVPYNMAHNAEHEACDLLMEIEQVDMLEKDIDENAYAKVCLYLTSCVNYVPEPENSALLRCALGVFRKFSRFPEALRLALMLNDMELVEDIFTSCKDVVVQKQMAFMLGRHGVFLELSEDVEEYEDLTEIMSNVQLNSNFLALARELDIMEPKVPDDIYKTHLENNRFGGSGSQVDSARMNLASSFVNGFVNAAFGQDKLLTDDGNKWLYKNKDHGMLSAAASLGMILLWDVDGGLTQIDKYLYSSEDYIKSGALLACGIVNSGVRNECDPALALLSDYVLHNSNTMRLGSIFGLGLAYAGSNREDVLTLLLPVMGDSKSSMEVAGVTALACGMIAVGSCNGDVTSTILQTIMEKSETELKDTYARWLPLGLGLNHLGKGEAIEAILAALEVVSEPFRSFANTLVDVCAYAGSGNVLKVQQLLHICSEHFDSKEKEEDKDKKEKKDKDKKEAPADMGAHQGVAVLGIALIAMGEEIGAEMALRTFGHLLRYGEPTLRRAVPLALALISVSNPRLNILDTLSKFSHDADPEVSYNSIFAMGMVGSGTNNARLAAMLRQLAQYHAKDPNNLFMVRLAQGLTHLGKGTLTLCPYHSDRQLMSQVAVAGLLTVLVSFLDVRNIILGKSHYVLYGLVAAMQPRMLVTFDEELRPLPVSVRVGQAVDVVGQAGKPKTITGFQTHTTPVLLAHGERAELATEEFLPVTPILEGFVILRKNPNYDL

SEQ ID NO: 46 - DNA, 2727 bp, Homosapien
atggaggagggaggccgggacaaggcgccggtgcagccccagcagtctccagcggcggcccccggcggcacggacgagaagccgagcggcaaggagcggcgggatgccggggacaaggacaaagaacaggagctgtctgaagaggataaacagcttcaagatgaactggagatgctcgtggaacgactaggggagaaggatacatccctgtatcgaccagcgctggaggaattgcgaaggcagattcgttcttctacaacttccatgacttcagtgcccaagcctctcaaatttctgcgtccacactatggcaaactgaaggaaatctatgagaacatggcccctggggagaataagcgttttgctgctgacatcatctccgttttggccatgaccatgagtggggagcgtgagtgcctcaagtatcggctagtgggctcccaggaggaattggcatcatggggtcatgagtatgtcaggcatctggcaggagaagtggctaaggagtggcaggagctggatgacgcagagaaggtccagcgggagcctctgctcactctggtgaaggaaatcgtcccctataacatggcccacaatgcagagcatgaggcttgcgacctgcttatggaaattgagcaggtggacatgctggagaaggacattgatgaaaatgcatatgcaaaggtctgcctttatctcaccagttgtgtgaattacgtgcctgagcctgagaactcagccctactgcgttgtgccctgggtgtgttccgaaagtttagccgcttccctgaagctctgagattggcattgatgctcaatgacatggagttggtagaagacatcttcacctcctgcaaggatgtggtagtacagaaacagatggcattcatgctaggccggcatggggtgttcctggagctgagtgaagatgtcgaggagtatgaggacctgacagagatcatgtccaatgtacagctcaacagcaacttcttggccttagctcgggagctggacatcatggagcccaaggtgcctgatgacatctacaaaacccacctagagaacaacaggtttgggggcagtggctctcaggtggactctgcccgcatgaacctggcctcctcttttgtgaatggctttgtgaatgcagcttttggccaagacaagctgctaacagatgatggcaacaaatggctttacaagaacaaggaccacggaatgttgagtgcagctgcatctcttgggatgattctgctgtgggatgtggatggtggcctcacccagattgacaagtacctgtactcctctgaggactacattaagtcaggagctcttcttgcctgtggcatagtgaactctggggtccggaatgagtgtgaccctgctctggcactgctctcagactatgttctccacaacagcaacaccatgagacttggttccatctttgggctaggcttggcttatgctggctcaaatcgtgaagatgtcctaacactgctgctgcctgtgatgggagattcaaagtccagcatggaggtggcaggtgtcacagctttagcctgtggaatgatagcagtagggtcctgcaatggagatgtaacttccactatccttcagaccatcatggagaagtcagagactgagctcaaggatacttatgctcgttggcttcctcttggactgggtctcaaccacctggggaagggtgaggccatcgaggcaatcctggctgcactggaggttgtgtcagagccattccgcagttttgccaacacactggtggatgtgtgtgcatatgcaggctctgggaatgtgctgaaggtgcagcagctgctccacatttgtagcgaacactttgactccaaagagaaggaggaagacaaagacaagaaggaaaagaaagacaaggacaagaaggaagcccctgctgacatgggagcacatcagggagtggctgttctggggattgcccttattgctatgggggaggagattggtgcagagatggcattacgaacctttggccacttgctgagatatggggagcctacactccggagggctgtacctttagcactggccctcatctctgtttcaaatccacgactcaacatcctggataccctaagcaaattctctcatgatgctgatccagaagtttcctataactccatttttgccatgggcatggtgggcagtggtaccaataatgcccgtctggctgcaatgctgcgccagttagctcaatatcatgccaaggacccaaacaacctcttcatggtgcgcttggcacagggcctgacacatttagggaagggcacccttaccctctgcccctaccacagcgaccggcagcttatgagccaggtggccgtggctggactgctcactgtgcttgtctctttcctggatgttcgaaacattattctaggcaaatcacactatgtattgtatgggctggtggctgccatgcagccccgaatgctggttacgtttgatgaggagctgcggccattgccagtgtctgtccgtgtgggccaggcagtggatgtggtgggccaggctggcaagccgaagactatcacagggttccagacgcatacaaccccagtgttgttggcccacggggaacgggcagaattggccactgaggagtttcttcctgttacccccattctggaaggttttgttatccttcggaagaaccccaattatgatctctaa

SEQ ID NO: 47 - protein, 642 aa, Homosapien
MKRSSVSSGGAGRLSMQELRSQDVNKQGLYTPQTKEKPTFGKLSINKPTSERKVSLFGKRTSGHGSRNSQLGIFSSSEKIKDPRPLNDKAFIQQCIRQLCEFLTENGYAHNVSMKSLQAPSVKDFLKIFTFLYGFLCPSYELPDTKFEEEVPRIFKDLGYPFALSKSSMYTVGAPHTWPHIVAALVWLIDCIKIHTAMKESSPLFDDGQPWGEETEDGIMHNKLFLDYTIKCYESFMSGADSFDEMNAELQSKLKDLFNVDAFKLESLEAKNRALNEQIARLEQEREKEPNRLESLRKLKASLQGDVQKYQAYMSNLESHSAILDQKLNGLNEEIARVELECETIKQENTRLQNIIDNQKYSVADIERINHERNELQQTINKLTKDLEAEQQKLWNEELKYARGKEAIETQLAEYHKLARKLKLIPKGAENSKGYDFEIKFNPEAGANCLVKYRAQVYVPLKELLNETEEEINKALNKKMGLEDTLEQLNAMITESKRSVRTLKEEVQKLDDLYQQKIKEAEEEDEKCASELESLEKHKHLLESTVNQGLSEAMNELDAVQREYQLVVQTTTEERRKVGNNLQRLLEMVATHVGSVEKHLEEQIAKVDREYEECMSEDLSENIKEIRDKYEKKATLIKSSEE

SEQ ID NO: 48 - DNA, 1929 bp, Homosapien
atgaagcgcagttcagtttccagcggtggtgctggccgcctctccatgcaggagttaagatcccaggatgtaaataaacaaggcctctatacccctcaaaccaaagagaaaccaacctttggaaagttgagtataaacaaaccgacatctgaaagaaaagtctcgctatttggcaaaagaactagtggacatggatcccggaatagtcaacttggtatattttccagttctgagaaaatcaaggacccgagaccacttaatgacaaagcattcattcagcagtgtattcgacaactctgtgagtttcttacagaaaatggttatgcacataatgtgtccatgaaatctctacaagctccctctgttaaagacttcctgaagatcttcacatttctttatggcttcctgtgcccctcatacgaacttcctgacacaaagtttgaagaagaggttccaagaatctttaaagaccttgggtatccttttgcactatccaaaagctccatgtacacagtgggggctcctcatacatggcctcacattgtggcagccttagtttggctaatagactgcatcaagatacatactgccatgaaagaaagctcacctttatttgatgatgggcagccttggggagaagaaactgaagatggaattatgcataataagttgtttttggactacaccataaaatgctatgagagttttatgagtggtgccgacagctttgatgagatgaatgcagagctgcagtcaaaactgaaggatttatttaatgtggatgcttttaagctggaatcattagaagcaaaaaacagagcattgaatgaacagattgcaagattggaacaagaaagagaaaaagaaccgaatcgtctagagtcgttgagaaaactgaaggcttccttacaaggagatgttcaaaagtatcaggcatacatgagcaatttggagtctcattcagccattcttgaccagaaattaaatggtctcaatgaggaaattgctagagtagaactagaatgtgaaacaataaaacaggagaacactcgactacagaatatcattgacaaccagaagtactcagttgcagacattgagcgaataaatcatgaaagaaatgaattgcagcagactattaataaattaaccaaggacctggaagctgaacaacagaagttgtggaatgaggagttaaaatatgccagaggcaaagaagcgattgaaacacaattagcagagtatcacaaattggctagaaaattaaaacttattcctaaaggtgctgagaattccaaaggttatgactttgaaattaagtttaatcccgaggctggtgccaactgccttgtcaaatacagggctcaagtttatgtacctcttaaggaactcctgaatgaaactgaagaagaaattaataaagccctaaataaaaaaatgggtttggaggatactttagaacaattgaatgcaatgataacagaaagcaagagaagtgtgagaactctgaaagaagaagttcaaaagctggatgatctttaccaacaaaaaattaaggaagcagaggaagaggatgaaaaatgtgccagtgagcttgagtccttggagaaacacaagcacctgctagaaagtactgttaaccaggggctcagtgaagctatgaatgaattagatgctgttcagcgggaataccaactagttgtgcaaaccacgactgaagaaagacgaaaagtgggaaataacttgcaacgtctgttagagatggttgctacacatgttgggtctgtagagaaacatcttgaggagcagattgctaaagttgatagagaatatgaagaatgcatgtcagaagatctctcggaaaatattaaagagattagagataagtatgagaagaaagctactctaattaagtcttctgaagaatga

SEQ ID NO: 49 - protein, 298 aa, Homosapien
MWGACKVKVHDSLATISITLRRYLRLGATMAKSKFEYVRDFEADDTCLAHCWVVVRLDGRNFHRFAEKHNFAKPNDSRALQLMTKCAQTVMEELEDIVIAYGQSDEYSFVFKRKTNWFKRRASKFMTHVASQFASSYVFYWRDYFEDQPLLYPPGFDGRVVVYPSNQTLKDYLSWRQADCHINNLYNTVFWALIQQSGLTPVQAQGRLQGTLAADKNEILFSEFNINYNNELPMYRKGTVLIWQKVDEVMTKEIKLPTEMEGKKMAVTRTRTKPVPLHCDIIGDAFWKEHPEILDEDS

SEQ ID NO: 50 - DNA, 897 bp, Homosapien
atgtggggcgcctgtaaagttaaggttcacgattccttggccaccatttccatcactctgagacggtacctgagattgggggcgaccatggcaaaaagcaagttcgagtacgtgagggacttcgaggctgacgacacctgcctggcacactgctgggtggtagtgcggctggacggccggaatttccatcggtttgctgagaagcacaactttgcaaaacccaatgacagccgtgctctccagctgatgaccaaatgtgcgcagactgtgatggaagaactagaggatattgtgatcgcgtatggacagagtgatgagtacagctttgtgttcaagcggaaaaccaattggtttaaaagaagagccagtaagttcatgactcacgtggcctcccagtttgcctccagctatgtgttttattggcgggattactttgaggaccagccccttctgtatcccccaggctttgacggaagagtcgtggtgtatcccagcaaccagactttaaaggactacctcagctggcgacaagcagattgtcacatcaataatctttataatacagttttctgggcacttatacaacaatctggactaacaccagtacaagcccaagggagattacagggaactcttgcagcagacaagaatgagattttgttttctgaattcaacatcaactataataatgagctgccgatgtataggaaagggactgtgttgatatggcagaaggtggatgaagtgatgacaaaagaaattaagctgccaacagaaatggaaggaaaaaagatggcagtgacccggaccaggacaaagccagtgcccttgcactgcgatatcatcggggatgctttctggaaggaacatccagagattctagatgaagacagctga

SEQ ID NO: 51 - protein, 2472 aa, Homosapien
MTARGQSPLAPLLETLEDPSASHGGQTDAYLTLTSRMTGEEGKEVITEIEKKLPRLYKVLKTHISSQNSELSSAALQALGFCLYNPKITSELSEANALELLSKLNDTIKNSDKNVRTRALWVISKQTFPSEVVGKMVSSIIDSLEILFNKGETHSAVVDFEALNVIVRLIEQAPIQMGEEAVRWAKLVIPLVVHSAQKVHLRGATALEMGMPLLLQKQQEIASITEQLMTTKLISELQKLFMSKNETYVLKLWPLFVKLLGRTLHRSGSFINSLLQLEELGFRSGAPMIKKIAFIAWKSLIDNFALNPDILCSAKRLKLLMQPLSSIHVRTETLALTKLEVWWYLLMRLGPHLPANFEQVCVPLIQSTISIDSNASPQGNSCHVATSPGLNPMTPVHKGASSPYGAPGTPRMNLSSNLGGMATIPSIQLLGLEMLLHFLLGPEALSFAKQNKLVLSLEPLEHPLISSPSFFSKHANTLITAVHDSFVAVGKDAPDVVVSAIWKELISLVKSVTESGNKKEKPGSEVLTLLLKSLESIVKSEVFPVSKTLVLMEITIKGLPQKVLGSPAYQVANMDILNGTPALFLIQLIFNNFLECGVSDERFFLSLESLVGCVLSGPTSPLAFSDSVLNVINQNAKQLENKEHLWKMWSVIVTPLTELINQTNEVNQGDALEHNFSAIYGALTLPVNHIFSEQRFPVATMKTLLRTWSELYRAFARCAALVATAEENLCCEELSSKIMSSLEDEGFSNLLFVDRIIYIITVMVDCIDFSPYNIKYQPKVKSPQRPSDWSKKKNEPLGKLTSLFKLIVKVIYSFHTLSFKEAHSDTLFTIGNSITGIISSVLGHISLPSMIRKIFATLTRPLALFYENSKLDEVPKVYSCLNNKLEKLLGEIIACLQFSYTGTYDSELLEQLSPLLCIIFLHKNKQIRKQSAQFWNATFAKVMMLVYPEELKPVLTQAKQKFLLLLPGLETVEMMEESSGPYSDGTENSQLNVKISGMERKSNGKRDSFLAQTKNKKENMKPAAKLKLESSSLKVKGEILLEEEKSTDFVFIPPEGKDAKERILTDHQKEVLKTKRCDIPAMYNNLDVSQDTLFTQYSQEEPMEIPTLTRKPKEDSKMMITEEQMDSDIVIPQDVTEDCGMAEHLEKSSLSNNECGSLDKTSPEMSNSNNDERKKALISSRKTSTECASSTENSFVVSSSSVSNTTVAGTPPYPTSRRQTFITLEKFDGSENRPFSPSPLNNISSTVTVKNNQETMIKTDFLPKAKQREGTFSKSDSEKIVNGTKRSSRRAGKAEQTGNKRSKPLMRSEPEKNTEESVEGIVVLENNPPGLLNQTECVSDNQVHLSESTMEHDNTKLKAATVENAVLLETNTVEEKNVEINLESKENTPPVVISADQMVNEDSQVQITPNQKTLRRSSRRRSEVVESTTESQDKENSHQKKERRKEEEKPLQKSPLHIKDDVLPKQKLIAEQTLQENLIEKGSNLHEKTLGETSANAETEQNKKKADPENIKSEGDGTQDIVDKSSEKLVRGRTRYQTRRASQGLLSSIENSESDSSEAKEEGSRKKRSGKWKNKSNESVDIQDQEEKVVKQECIKAENQSHDYKATSEEDVSIKSPICEKQDESNTVICQDSTVTSDLLQVPDDLPNVCEEKNETSKYAEYSFTSLPVPESNLRTRNAIKRLHKRDSFDNCSLGESSKIGISDISSLSEKTFQTLECQHKRSRRVRRSKGCDCCGEKSQPQEKSLIGLKNTENNDVEISETKKADVQAPVSPSETSQANPYSEGQFLDEHHSVNFHLGLKEDNDTINDSLIVSETKSKENTMQESLPSGIVNFREEICDMDSSEAMSLESQESPNENFKTVGPCLGDSKNVSQESLETKEEKPEETPKMELSLENVTVEGNACKVTESNLEKAKTMELNVGNEASFHGQERTKTGISEEAAIEENKRNDDSEADTAKLNAKEVATEEFNSDISLSDNTTPVKLNAQTEISEQTAAGELDGGNDVSDLHSSEETNTKMKNNEEMMIGEAMAETGHDGETENEGITTKTSKPDEAETNMLTAEMDNFVCDTVEMSTEEGIIDANKTETNTEYSKSEEKLDNNQMVMESDILQEDHHTSQKVEEPSQCLASGTAISELIIEDNNASPQKLRELDPSLVSANDSPSGMQTRCVWSPLASPSTSILKRGLKRSQEDEISSPVNKVRRVSFADPIYQAGLADDIDRRCSIVRSHSSNSSPIGKSVKTSPTTQSKHNTTSAKGFLSPGSRSPKFKSSKKCLISEMAKESIPCPTESVYPPLVNCVAPVDIILPQITSNMWARGLGQLIRAKNIKTIGDLSTLTASEIKTLPIRSPKVSNVKKALRIYHEQQVKTRGLEEIPVFDISEKTVNGIENKSLSPDEERLVSDIIDPVALEIPLSKNLLAQISALALQLDSEDLHNYSGSQLFEMHEKLSCMANSVIKNLQSRWRSPSHENSI

SEQ ID NO: 52 - DNA, 7419 bp, Homosapien
atgacggccaggggtcagagccccctcgcgccgctgttggagactttggaagacccttctgcctcccatggagggcagactgacgcttacctgactctgaccagtcgtatgactggagaagaaggaaaagaagtaattacagaaattgagaaaaaacttcctcggctgtacaaagttttaaagactcacatttccagtcaaaactcggagctgagtagtgctgctctacaagccctggggttttgcttatataatcccaaaattacctcagaattatcagaggcaaatgctctagaattgctttcaaaattgaatgataccattaagaattcagacaaaaatgtacgtactagagcactttgggtgatatctaagcagacatttccctctgaagtggttggcaaaatggtatccagtataattgattcattagaaatactgtttaacaaaggagagacgcattctgctgttgttgattttgaagcattaaatgttatcgtaaggctaattgaacaagccccaattcaaatgggagaagaggcagtgaggtgggcaaaactggtcatacctttagtggttcattcagcacaaaaggtacatttgcggggagcaactgctctggagatgggaatgccattattgcttcagaaacagcaagaaatagcatctattacggagcagcttatgactactaaattaatctcagaacttcagaagctatttatgagtaaaaatgagacttacgtgttaaaattatggcctttgtttgtcaaactacttggaaggaccttgcatcgaagtgggagtttcatcaattctctcttgcaactagaagaacttggatttcgtagtggagcacccatgattaaaaagatagcttttattgcttggaagagtttaatagataattttgctttaaatccagatatactatgtagtgcaaaaagactcaagttgttaatgcagcctttgagttccatccatgtgagaacagaaactctagcattaacaaaactagaagtctggtggtatttactgatgagacttggacctcatcttcctgctaattttgaacaggtttgtgtgcctctgattcaaagtacaataagcattgattctaatgcctcacctcagggcaattcgtgtcatgtagctacatctccaggtttaaatcctatgactcctgtacacaaaggtgcttcctccccgtacggagccccgggaactccccgaatgaacctgagttcgaatttaggtggaatggccacaatcccatccattcaacttttgggacttgaaatgttgcttcatttcttgttgggtccagaagccttgagttttgctaagcaaaataaacttgtgctgagcttagagccattggaacatccgttaatcagcagcccttcctttttttccaaacatgcaaatacacttatcactgctgttcatgatagctttgttgcagttggaaaagatgcccccgatgtggttgtcagtgctatctggaaggagctaattagcttggtgaagtcagttactgaatcaggtaacaaaaaagagaaaccaggttctgaagttttgactctcttattaaagtctttggaaagcatagtaaagtctgaagtatttcctgtatcaaaaacgctggtcctcatggaaattacaattaaaggacttcctcagaaagtattaggttcaccagcatatcaggttgctaatatggatattcttaatggaactccagctttgttcttaattcaattaattttcaacaatttcttggaatgtggtgtatcagatgaaaggttctttctcagtttggaatcacttgtaggctgtgttctttctggtccaacttcaccactagctttcagtgactcagttttaaatgttattaatcaaaatgcaaagcagttggaaaataaggagcatctctggaaaatgtggagtgttatagtcaccccattaactgaattgattaatcagaccaatgaagtaaatcaaggtgatgccttagaacataattttagtgccatctatggtgcattgactttaccagtaaaccacattttttcagaacagagatttccagtggccaccatgaagactttgcttagaacttggtcagaattatatagagcatttgctcgttgtgctgctttggtggcaacagcagaagagaacttgtgctgtgaggaactttcttccaagataatgtccagtttggaagatgaaggcttttctaatttgttgttcgtggatagaattatttatattattactgtaatggttgattgcattgacttctcaccatataatattaaatatcagcccaaagttaaatcaccacagagaccttcagattggtccaaaaagaagaatgagcccctagggaaattgacttctttatttaaacttattgtgaaagtgatctattctttccacacactgagcttcaaggaagcacattctgataccctcttcactattggcaactcaatcaccggcattatttccagtgtacttgggcatatttctttgccttctatgatccgaaaaatatttgcaactttaacaagacctctggcattattttatgaaaactcaaagcttgatgaagttcctaaagtatatagttgtctgaacaacaagttagaaaagctactgggagaaattattgcttgtctgcaattcagctacaccggaacttatgatagtgaacttcttgaacaactctccccactattatgcataatatttctgcacaagaataaacagattcgaaaacagagtgctcagttctggaatgccacttttgccaaagtgatgatgttggtttatcctgaagagttaaaaccagtactaacacaagccaaacaaaaatttctgctcctgttgcctggtttggaaactgttgaaatgatggaggaatccagtggaccatattctgatggaacagaaaattcacaactaaatgtgaagataagtggcatggagagaaaatcaaatggaaaaagagattcatttttggcacaaacaaagaataaaaaagaaaatatgaaaccagcagccaaactgaaacttgaatcttcgtctttaaaagtaaagggtgaaattcttttggaagaggaaaagtctactgactttgtgtttatacctccagaaggaaaagatgcaaaggaaagaatattaactgatcatcaaaaagaagttctcaaaacaaagcggtgtgatattcctgccatgtataataatctggatgtttcccaagataccttatttactcagtatagtcaggaagagcctatggaaattcctactttaaccagaaaaccaaaggaggattctaagatgatgattacggaggagcaaatggacagtgacattgtcattcctcaagatgtcacggaagactgtggtatggctgaacatcttgaaaagtcctccctttcgaataatgagtgtggttctcttgacaaaaccagtccagaaatgtcaaacagtaataatgatgaaagaaaaaaagctttaatttcatcaaggaaaacatcaactgaatgtgcatctagtacagaaaattctttcgttgtcagcagtagttcagtttctaataccactgttgctggaactcccccataccctacaagtcggaggcaaacctttattactttggagaagtttgatggttcagaaaatagaccttttagtccatcccccttgaataatatttcatcaactgttacagtgaaaaataaccaggaaaccatgattaaaacagattttctaccaaaagcaaagcaaagagaagggactttttcaaaatctgattctgaaaaaatagtgaatggaactaagagatcaagccggagagctggtaaagctgaacaaacagggaataaaaggtctaagcccttaatgagatctgagccggagaaaaatactgaggaatctgttgaaggcattgtagtcttagaaaataacccacctggtttgcttaatcaaacagaatgtgtgtcagataatcaggttcatctttctgaatctacaatggagcatgacaatacaaagcttaaagcagcaacagtggaaaatgctgtattattggaaactaatactgtagaggagaaaaatgtagaaattaatttggaatccaaagagaatacacccccagtagtaatatcagcagatcaaatggtaaatgaggatagtcaggttcagataactccaaatcagaaaacccttagacggtcttcaaggcgacgttcagaagtagtagagtctaccactgaaagccaagataaggaaaatagtcatcaaaaaaaggaacgacgtaaggaagaagaaaaacctcttcagaagagtccattgcatataaaagatgatgtgttacctaaacaaaaactgattgctgaacaaactctacaggagaatttaattgagaaaggaagtaatttacatgagaagactcttggggaaactagtgctaatgcagaaactgaacaaaataaaaaaaaggcagaccctgagaacattaagtctgagggggatggtacccaggacattgtagataagtcctctgagaaactagtcagaggccgaacacggtatcaaactagaagagcatctcagggtttgctttccagcattgaaaactcagaatctgatagttcggaggcaaaagaagaaggttctaggaagaagagatctggaaaatggaaaaacaaaagcaatgaaagtgttgacattcaagatcaagaagagaaagtggtgaaacaggaatgtataaaagctgaaaatcagtcacatgattataaagcaacttctgaagaagatgtaagcataaaatctccgatttgcgaaaaacaagatgaaagtaatactgtaatatgtcaggattctacagtaacttcagatttgttgcaagttcctgatgatttaccaaatgtgtgtgaggaaaaaaatgaaactagcaaatatgcagaatattcctttacaagtctacctgtgccagaatcaaatctaaggactagaaatgccattaagagattacataagcgagactcttttgataattgtagtttgggagaatcctcaaaaatagggatatcagatatttcttcgctttcagaaaaaacttttcaaacacttgaatgccaacacaagagaagtaggagggtgaggagatctaaaggttgtgattgctgtggggaaaaatcacaacctcaggaaaagtcactcattgggttaaagaatacagaaaataatgacgtagagattagtgaaacaaaaaaggcagatgtgcaagcacctgtaagcccatcagaaacttctcaagctaatccatattctgaaggacaatttttagatgaacatcatagtgtgaattttcatttgggtctcaaagaggataatgatactattaatgattcattaattgtttctgaaaccaaatcaaaagaaaacactatgcaagaatctcttccttctggaatagtaaactttagagaggaaatttgtgatatggattctagtgaagcaatgtctcttgaaagccaggagtcacctaatgaaaattttaaaactgttggcccgtgtttaggagactcgaaaaatgtttcacaggaatctttggagacaaaagaagaaaaaccagaagaaaccccaaaaatggaactgagtctagagaatgttactgttgaaggaaatgcatgtaaagtaacagaatccaatctagagaaagcaaaaactatggaattgaatgtaggaaatgaagctagctttcatggacaagagagaaccaaaactggtatttctgaagaagcagcaatagaagaaaataaaagaaatgatgactctgaagcagacacagctaaactgaatgccaaagaagtagcaactgaggaatttaattcagatattagtctttctgataatactacacctgtaaaattgaatgctcaaactgagatttctgaacaaacagcagctggggaactagatggaggaaatgatgtatctgatctacactcatctgaagaaacgaataccaaaatgaaaaataatgaagaaatgatgatcggcgaggcaatggctgaaactggccatgatggtgaaacagagaatgagggcataactaccaaaacctcaaagcctgatgaagctgaaacaaacatgttgactgcagaaatggacaactttgtttgtgacacagttgaaatgagcactgaagaaggaatcattgacgctaataaaactgaaacaaatactgagtatagtaaatctgaagaaaaattagataacaatcaaatggtaatggaaagtgatattttacaggaagatcaccatacttcacagaaagtggaggaaccatcacagtgtctggcatctggaacagctatctctgagctaataatagaagacaataatgcatctcctcaaaaactaagggaacttgatccttcacttgtgtcagcaaatgacagtcctagtggcatgcagacacgctgtgtctggtctcctttggcttctccgtctacgagcattttaaagagaggactaaaaagatcccaagaagatgaaatctcatcacctgttaataaggttcgccgtgtctcctttgcagatccaatataccaagcaggattggcagatgacattgatagacggtgctctattgttaggtcccattcttccaatagttctcccataggaaaaagtgttaaaacttctcctactacacaatctaagcataataccacttcagccaaaggatttctgtccccaggatcacgtagccctaaatttaagagctcaaagaagtgtttaatttcagaaatggccaaagaatccataccatgcccaacagaaagtgtttacccaccattggtgaactgtgtggcaccagttgacatcattttacctcagattacatcaaacatgtgggcaagaggcctgggacaactcattagagctaagaatataaaaactattggtgatttgagtactcttacagcatctgaaataaaaactcttcctatccgttctccaaaagtgtccaatgtaaaaaaggctctcagaatatatcatgagcagcaggtgaagactcgtggactagaagagattccagtttttgatatttctgaaaaaacagtaaatggaatagaaaataaatctttgtcacctgatgaagaaagacttgtctcagatataattgatcctgttgctttagaaattccattatccaaaaaccttctggcacagattagtgctcttgctcttcagctggattcagaagatcttcataattattcaggaagccaactatttgaaatgcacgagaaactaagttgtatggcaaactctgtaataaaaaatctacagtcacgttggagatcaccatcccatgaaaattctatttag

SEQ ID NO: 53 - protein, 681 aa, Homosapien
MAPQVWRRRTLERCLTEVGKATGRPECFLTIQEGLASKFTSLTKVLYDFNKILENGRIHGSPLQKLVIENFDDEQIWQQLELQNEPILQYFQNAVSETINDEDISLLPESEEQEREEDGSEIEADDKEDLEDLEEEEVSDMGNDDPEMGERAENSSKSDLRKSPVFSDEDSDLDFDISKLEQQSKVQNKGQGKPREKSIVDDKFFKLSEMEAYLENIEKEEERKDDNDEEEEDIDFFEDIDSDEDEGGLFGSKKLKSGKSSRNLKYKDFFDPVESDEDITNVHDDELDSNKEDDEIAEEEAEELSISETDEDDDLQENEDNKQHKESLKRVTFALPDDAETEDTGVLNVKKNSDEVKSSFEKRQEKMNEKIASLEKELLEKKPWQLQGEVTAQKRPENSLLEETLHFDHAVRMAPVITEETTLQLEDIIKQRIRDQAWDDVVRKEKPKEDAYEYKKRLTLDHEKSKLSLAEIYEQEYIKLNQQKTAEEENPEHVEIQKMMDSLFLKLDALSNFHFIPKPPVPEIKVVSNLPAITMEEVAPVSVSDAALLAPEEIKEKNKAGDIKTAAEKTATDKKRERRKKKYQKRMKIKEKEKRRKLLEKSSVDQAGKYSKTVASEKLKQLTKTGKASFIKDEGKDKALKSSQAFFSKLQDQVKMQINDAKKTEKKKKKRQDISVHKLKL

SEQ ID NO: 54 - DNA, 2046 bp, Homosapien
atggcgccgcaggtctggcgtcgacggaccctggagcggtgtctgacggaagtcggcaaagccacgggtcggcccgagtgcttcctcacgattcaagagggattggcatcaaagttcacttctttaacaaaagtgctttatgactttaataaaatattagagaatggtaggatccatggaagccccttgcaaaaacttgtgatagaaaattttgatgatgagcagatttggcaacaactggaattgcaaaatgaaccaattttacaatactttcagaatgcagttagtgaaacaattaatgatgaagatatcagtcttctcccagagagtgaagaacaggaacgtgaagaggatggttcagagatagaggctgatgacaaggaggacctagaagatttagaggaggaggaagtgtccgacatgggtaatgatgatcctgaaatgggtgagagagctgaaaactcaagcaaatctgatctgaggaaaagccccgttttcagtgatgaggattctgaccttgactttgatatcagcaaattggaacagcagagcaaggtgcaaaacaaaggacagggaaaaccaagagaaaagtccatagtagatgataaattcttcaaactctctgaaatggaggcctatttagaaaacatagaaaaagaagaggaacgaaaagatgataatgatgaggaggaggaagatattgatttttttgaagatattgattctgatgaagatgaagggggactgtttggaagtaaaaaacttaagtcaggtaaaagttccagaaatctgaaatacaaagatttttttgatccagttgaaagtgatgaagacataacaaatgttcatgatgatgagctggattcaaacaaagaagatgatgaaattgctgaagaagaagcagaagaactaagtatttcggaaacggatgaagatgatgaccttcaagaaaatgaagacaataaacaacataaagaaagcttgaaaagagtgacctttgctttaccagatgatgcggaaactgaagatacaggtgttttaaatgtaaagaaaaattctgatgaagttaaatcctcctttgaaaaaagacaggaaaagatgaatgaaaaaattgcatctttagaaaaagagttgttagaaaaaaagccgtggcagcttcagggggaagtgacagcacagaagaggccagagaacagcctcctggaggagaccctacactttgaccatgctgtccggatggcacctgtgattacagaggaaaccacccttcaactggaagatatcattaaacagaggataagagatcaggcttgggatgatgtagtacgtaaagaaaaacctaaagaggatgcatatgaatataaaaagcgtttaaccttagaccatgagaagagtaaattgagccttgctgaaatttatgaacaggagtacatcaaactcaaccagcaaaaaacagcagaagaagaaaatccagaacatgtagaaattcagaagatgatggattccctcttcttaaaattggatgccctctcaaacttccactttatccctaaaccgcctgtaccagagattaaagttgtgtcaaatctgccagccataaccatggaggaagtagccccagtgagtgttagtgatgcagctctcctggccccagaggagatcaaggagaaaaataaagctggagatataaaaacagctgctgaaaaaacagctacagacaagaaacgagagcgaaggaaaaagaaatatcaaaagcgtatgaaaataaaagagaaggagaagcggagaaaactgcttgaaaagagcagtgtagatcaagcagggaaatacagcaaaacagtagcttcggagaagttaaaacagctgaccaaaactggcaaagcttccttcataaaggatgaaggtaaagacaaggccttaaagtcctctcaagcattcttttctaaattacaagatcaagtaaaaatgcaaatcaatgatgcaaagaaaacagaaaagaaaaagaagaaaagacaggatatttctgttcataaattaaagctgtaa

SEQ ID NO: 55 - protein, 897 aa, Homosapien
RKGVLKDPEIADLFYKDDPEELFIGLHEIGHGSFGAVYFATNAHTNEVVAIKKMSYSGKQTHEKWQDILKEVKFLRQLKHPNTIEYKGCYLKEHTAWLVMEYCLGSASDLLEVHKKPLQEVEIAAITHGALHGLAYLHSHALIHRDIKAGNILLTEPGQVKLADFGSASMASPANSFVGTPYWMAPEVILAMDEGQYDGKVDIWSLGITCIELAERKPPLFNMNAMSALYHIAQNDSPTLQSNEWTDSFRRFVDYCLQKIPQERPTSAELLRHDFVRRDRPLRVLIDLIQRTKDAVRELDNLQYRKMKKILFQETRNGPLNESQEDEEDSEHGTSLNREMDSLGSNHSIPSMSVSTGSQSSSVNSMQEVMDESSSELVMMHDDESTINSSSSVVHKKDHVFIRDEAGHGDPRPEPRPTQSVQSQALHYRNRERFATIKSASLVTRQIHEHEQENELREQMSGYKRMRRQHQKQLIALENKLKAEMDEHRLKLQKEVETHANNSSIELEKLAKKQVAIIEKEAKVAAADEKKFQQQILAQQKKDLTTFLESQKKQYKICKEKIKEEMNEDHSTPKKEKQERISKHKENLQHTQAEEEAHLLTQQRLYYDKNCRFFKRKIMIKRHEVEQQNIREELNKKRTQKEMEHAMLIRHDESTRELEYRQLHTLQKLRMDLIRLQHQTELENQLEYNKRRERELHRKHVMELRQQPKNLKAMEMQIKKQFQDTCKVQTKQYKALKNHQLEVTPKNEHKTILKTLKDEQTRKLAILAEQYEQSINEMMASQALRLDEAQEAECQALRLQLQQEMELLNAYQSKIKMQTEAQHERELQKLEQRVSLRRAHLEQKIEEELAALQKERSERIKNLLERQEREIETFDMESLRMGFGNLVTLDFPKEDYR

SEQ ID NO: 56 - DNA, 2697 bp, Homosapien
atgcgtaaaggggtgctgaaggacccagagattgccgatctattctacaaagatgatcctgaggaactttttattggtttgcatgaaattggacatggaagttttggagcagtttattttgctacaaatgctcacaccaatgaggtggtggcaattaagaagatgtcctatagtgggaagcagacccatgagaaatggcaagatattcttaaggaagttaaatttttacgacaattgaagcatcctaatactattgagtacaaaggctgttacttgaaagaacacactgcttggttggtgatggaatattgcttaggctcagcctctgatttattagaagttcataaaaaaccacttcaggaagtggagatcgctgccattactcatggagccttgcatggactagcctacctacattctcatgcattgattcatagggatattaaagcaggaaatattcttctaacagagccaggtcaggtaaaactagctgattttggatctgcttcaatggcttctcctgccaactccttcgtgggcacaccttactggatggctccagaggtgatcttagctatggatgaaggacagtatgatgggaaagttgatatttggtcacttggcatcacttgtattgaattggcggaacggaagccgccccttttcaacatgaatgcaatgagtgccttatatcacattgcccagaatgactccccaacgttacagtctaatgaatggacagactcctttaggagatttgttgattactgcttgcagaaaatacctcaggaaaggccaacatcagcagaactattaaggcatgactttgttcgacgagaccggccactacgtgtcctcattgacctcatacagaggacaaaagatgcagttcgtgagctagataacctacagtaccgaaaaatgaaaaaaatacttttccaagagacacggaatggacccttgaatgagtcacaggaggatgaggaagacagtgaacatggaaccagcctgaacagggaaatggacagcctgggcagcaaccattccattccaagcatgtccgtgagcacaggcagccagagcagcagtgtgaacagcatgcaggaagtcatggacgagagcagttccgaacttgtcatgatgcacgatgacgaaagcacaatcaattccagctcctccgtcgtgcataagaaagatcatgtattcataagggatgaggcgggccacggcgatcccaggcctgagccgcggcctacccagtcagttcagagccaggccctccactaccggaacagagagcgctttgccacgatcaaatcagcatctttggttacacgacagatccatgagcatgagcaggagaacgagttgcgggaacagatgtcaggttataagcggatgcggcgccagcaccagaagcagctgatcgccctggagaacaagctgaaggctgagatggacgagcaccgcctcaagctacagaaggaggtggagacgcatgccaacaactcgtccatcgagctggagaagctggccaagaagcaagtggctatcatagaaaaggaggcaaaggtagctgcagcagatgagaagaagttccagcaacagatcttggcccagcagaagaaagatttgacaactttcttagaaagtcagaagaagcagtataagatttgtaaggaaaaaataaaagaggaaatgaatgaggaccatagcacacccaagaaagagaagcaagagcggatctccaaacataaagagaacttgcagcacacacaggctgaagaggaagcccaccttctcactcaacagagactgtactacgacaaaaattgtcgtttcttcaagcggaaaataatgatcaagcggcacgaggtggagcagcagaacattcgggaggaactaaataaaaagaggacccagaaggagatggagcatgccatgctaatccggcacgacgagtccacccgagagctagagtacaggcagctgcacacgttacagaagctacgcatggatctgatccgtttacagcaccagacggaactggaaaaccagctggagtacaataagaggcgagaaagagaactgcacagaaagcatgtcatggaacttcggcaacagccaaaaaacttaaaggccatggaaatgcaaattaaaaaacagtttcaggacacttgcaaagtacagaccaaacagtataaagcactcaagaatcaccagttggaagttactccaaagaatgagcacaaaacaatcttaaagacactgaaagatgagcagacaagaaaacttgccattttggcagagcagtatgaacagagtataaatgaaatgatggcctctcaagcgttacggctagatgaggctcaagaagcagaatgccaggccttgaggctacagctccagcaggaaatggagctgctcaacgcctaccagagcaaaatcaagatgcaaacagaggcacaacatgaacgtgagctccagaagctagagcagagagtgtctctgcgcagagcacaccttgagcagaagattgaagaggagctggctgcccttcagaaggaacgcagcgagagaataaagaacctattggaaaggcaagagcgagagattgaaacttttgacatggagagcctcagaatgggatttgggaatttggttacattagattttcctaaggaggactacagatga

SEQ ID NO: 57 - protein, 764 aa, Homosapien
MNGEADCPTDLEMAAPKGQDRWSQEDMLTLLECMKNNLPSNDSSKFKTTESHMDWEKVAFKDFSGDMCKLKWVEISNEVRKFRTLTELILDAQEHVKNPYKGKKLKKHPDFPKKPLTPYFRFFMEKRAKYAKLHPEMSNLDLTKILSKKYKELPEKKKMKYIQDFQREKQEFERNLARFREDHPDLIQNAKKSDIPEKPKTPQQLWYTHEKKVYLKVRPDATTKEVKDSLGKQWSQLSDKKRLKWIHKALEQRKEYEEIMRDYIQKHPELNISEEGITKSTLTKAERQLKDKFDGRPTKPPPNSYSLYCAELMANMKDVPSTERMVLCSQQWKLLSQKEKDAYHKKCDQKKKDYEVELLRFLESLPEEEQQRVLGEEKMLNINKKQATSPASKKPAQEGGKGGSEKPKRPVSAMFIFSEEKRRQLQEERPELSESELTRLLARMWNDLSEKKKAKYKAREAALKAQSERKPGGEREERGKLPESPKRAEEIWQQSVIGDYLARFKNDRVKALKAMEMTWNNMEKKEKLMWIKKAAEDQKRYERELSEMRAPPAATNSSKKMKFQGEPKKPPMNGYQKFSQELLSNGELNHLPLKERMVEIGSRWQRISQSQKEHYKKLAEEQQKQYKVHLDLWVKSLSPQDRAAYKEYISNKRKSMTKLRGPNPKSSRTTLQSKSESEEDDEEDEDDEDEDEEEEDDENGDSSEDGGDSSESSSEDESEDGDENEEDDEDEDDDEDDDEDEDNESEGSSSSSSSSGDSSDSDSN

SEQ ID NO: 58 - DNA, 2295 bp, Homosapien
atgaacggagaagccgactgccccacagacctggaaatggccgcccccaaaggccaagaccgttggtcccaggaagacatgctgactttgctggaatgcatgaagaacaaccttccatccaatgacagctccaagttcaaaaccaccgaatcacacatggactgggaaaaagtagcatttaaagacttttctggagacatgtgcaagctcaaatgggtggagatttctaatgaggtgaggaagttccgtacattgacagaattgatcctcgatgctcaggaacatgttaaaaatccttacaaaggcaaaaaactcaagaaacacccagacttcccaaagaagcccctgaccccttatttccgcttcttcatggagaagcgggccaagtatgcgaaactccaccctgagatgagcaacctggacctaaccaagattctgtccaagaaatacaaggagcttccggagaagaagaagatgaaatatattcaggacttccagagagagaaacaggagttcgagcgaaacctggcccgattcagggaggatcaccccgacctaatccagaatgccaagaaatcggacatcccagagaagcccaaaaccccccagcagctgtggtacacccacgagaagaaggtgtatctcaaagtgcggccagatgccactacgaaggaggtgaaggactccctggggaagcagtggtctcagctctcggacaaaaagaggctgaaatggattcataaggccctggagcagcggaaggagtacgaggagatcatgagagactatatccagaagcacccagagctgaacatcagtgaggagggtatcaccaagtccaccctcaccaaggccgaacgccagctcaaggacaagtttgacgggcgacccaccaagccacctccgaacagctactcgctgtactgcgcagagctcatggccaacatgaaggacgtgcccagcacagagcgcatggtgctgtgcagccagcagtggaagctgctgtcccagaaggagaaggacgcctatcacaagaagtgtgatcagaaaaagaaagattacgaggtggagctgctccgtttcctcgagagcctgcctgaggaggagcagcagcgggtcttgggggaagagaagatgctgaacatcaacaagaagcaggccaccagccccgcctccaagaagccagcccaggaagggggcaagggcggctccgagaagcccaagcggcccgtgtcggccatgttcatcttctcggaggagaaacggcggcagctgcaggaggagcggcctgagctctccgagagcgagctgacccgcctgctggcccgaatgtggaacgacctgtctgagaagaagaaggccaagtacaaggcccgagaggcggcgctcaaggctcagtcggagaggaagcccggcggggagcgcgaggaacggggcaagctgcccgagtcccccaaaagagctgaggagatctggcaacagagcgttatcggcgactacctggcccgcttcaagaatgaccgggtgaaggccttgaaagccatggaaatgacctggaataacatggaaaagaaggagaaactgatgtggattaagaaggcagccgaagaccaaaagcgatatgagagagagctgagtgagatgcgggcacctccagctgctacaaattcttccaagaagatgaaattccagggagaacccaagaagcctcccatgaacggttaccagaagttctcccaggagctgctgtccaatggggagctgaaccacctgccgctgaaggagcgcatggtggagatcggcagtcgctggcagcgcatctcccagagccagaaggagcactacaaaaagctggccgaggagcagcaaaagcagtacaaggtgcacctggacctctgggttaagagcctgtctccccaggaccgtgcagcatataaagagtacatctccaataaacgtaagagcatgaccaagctgcgaggcccaaaccccaaatccagccggactactctgcagtccaagtcggagtccgaggaggatgatgaagaggatgaggatgacgaggacgaggatgaagaagaggaagatgatgagaatggggactcctctgaagatggcggcgactcctctgagtccagcagcgaggacgagagcgaggatggggatgagaatgaagaggatgacgaggacgaagacgacgacgaggatgacgatgaggatgaagataatgagtccgagggcagcagctccagctcctcctcctcaggggactcctcagactctgactccaactga

SEQ ID NO: 59 - protein, 1641 aa, Homosapien
MAGVGPGGYAAEFVPPPECPVFEPSWEEFTDPLSFIGRIRPLAEKTGICKIRPPKDWQPPFACEVKSFRFTPRVQRLNELEAMTRVRLDFLDQLAKFWELQGSTLKIPVVERKILDLYALSKIVASKGGFEMVTKEKKWSKVGSRLGYLPGKGTGSLLKSHYERILYPYELFQSGVSLMGVQMPNLDLKEKVEPEVLSTDTQTSPEPGTRMNILPKRTRRVKTQSESGDVSRNTELKKLQIFGAGPKVVGLAMGTKDKEDEVTRRRKVTNRSDAFNMQMRQRKGTLSVNFVDLYVCMFCGRGNNEDKLLLCDGCDDSYHTFCLIPPLPDVPKGDWRCPKCVAEECSKPREAFGFEQAVREYTLQSFGEMADNFKSDYFNMPVHMVPTELVEKEFWRLVSSIEEDVIVEYGADISSKDFGSGFPVKDGRRKILPEEEEYALSGWNLNNMPVLEQSVLAHINVDISGMKVPWLYVGMCFSSFCWHIEDHWSYSINYLHWGEPKTWYGVPSHAAEQLEEVMRELAPELFESQPDLLHQLVTIMNPNVLMEHGVPVYRTNQCAGEFVVTFPRAYHSGFNQGYNFAEAVNFCTADWLPIGRQCVNHYRRLRRHCVFSHEELIFKMAADPECLDVGLAAMVCKELTLMTEEETRLRESVVQMGVLMSEEEVFELVPDDERQCSACRTTCFLSALTCSCNPERLVCLYHPTDLCPCPMQKKCLRYRYPLEDLPSLLYGVKVRAQSYDTWVSRVTEALSANFNHKKDLIELRVMLEDAEDRKYPENDLFRKLRDAVKEAETCASVAQLLLSKKQKHRQSPDSGRTRTKLTVEELKAFVQQLFSLPCVISQARQVKNLLDDVEEFHERAQEAMMDETPDSSKLQMLIDMGSSLYVELPELPRLKQELQQARWLDEVRLTLSDPQQVTLDVMKKLIDSGVGLAPHHAVEKAMAELQELLTVSERWEEKAKVCLQARPRHSVASLESIVNEAKNIPAFLPNVLSLKEALQKAREWTAKVEAIQSGSNYAYLEQLESLSAKGRPIPVRLEALPQVESQVAAARAWRERTGRTFLKKNSSHTLLQVLSPRTDIGVYGSGKNRRKKVKELIEKEKEKDLDLEPLSDLEEGLEETRDTAMVVAVFKEREQKEIEAMHSLRAANLAKMTMVDRIEEVKFCICRKTASGFMLQCELCKDWFHNSCVPLPKSSSQKKGSSWQAKEVKFLCPLCMRSRRPRLETILSLLVSLQKLPVRLPEGEALQCLTERAMSWQDRARQALATDELSSALAKLSVLSQRMVEQAAREKTEKIISAELQKAAANPDLQGHLPSFQQSAFNRVVSSVSSSPRQTMDYDDEETDSDEDIRETYGYDMKDTASVKSSSSLEPNLFCDEEIPIKSEEVVTHMWTAPSFCAEHAYSSASKSCSQVFFGKGSSTPRKQPRKSPLVPRSLEPPVLELSPGAKAQLEELMMVGDLLEVSLDETQHIWRILQATHPPSEDRFLHIMEDDSMEEKPLKVKGKDSSEKKRKRKLEKVEQLFGEGKQKSKELKKMDKPRKKKLKLGADKSKELNKLAKKLAKEEERKKKKEKAAAAKVELVKESTEKKREKKVLDIPSKYDWSGAEESDDENAVCAAQNCQRPCKDKGVVFVTEEEKNKKY

SEQ ID NO: 60 - DNA, 4926 bp, Homosapien
atggcgggcgtggggccggggggctacgcggcggagttcgtgccaccgccagagtgccccgtctttgagccgagttgggaggagttcacagatccgctcagctttatcggccgcatccggcctttggcggagaaaaccggcatctgcaaaattcggccgcccaaggactggcagcctccatttgcctgtgaagtaaaaagctttcgtttcactccaagagtccagcgcctgaatgaacttgaggcaatgaccagagtgagattggatttcttggatcaactagcaaaattttgggaacttcaaggatctactctgaagatccctgtggtagagagaaaaatcctggatctgtatgctttgagcaagattgttgccagcaaaggaggttttgaaatggtcaccaaagagaagaaatggtctaaagtgggtagtcgcttgggatatctgccaggaaaaggaactgggtctcttttgaagtcacattatgaaagaattctctacccatatgagcttttccagtctggtgtgagccttatgggtgtgcagatgcctaatttagatcttaaagaaaaagtggagcctgaggttctcagcactgatacccaaacttccccagagccaggcacaaggatgaacattctgccgaagagaacaagacgtgtgaagactcagtcagaatctggagatgtgagtagaaacacggaactgaagaaacttcagatttttggggctgggcccaaggttgtgggcttggcaatgggaacaaaagataaagaagatgaggtcacccgaagacgaaaagttaccaacaggtcagacgcatttaacatgcaaatgagacaacggaaaggcactctctctgttaactttgttgatctctatgtttgtatgttttgtggtcggggaaacaatgaagataaattgcttttgtgtgatggatgtgatgacagctatcatacattttgtctaattcctccactacctgatgtgcccaaaggagactggaggtgtcctaaatgtgtcgccgaggaatgtagcaaacctcgagaagcctttggatttgaacaagctgtacgagagtatacacttcagagctttggagagatggcagataattttaagtctgattattttaatatgccagtccatatggttcccacagaactagtagaaaaggaattttggcggctggtaagcagcattgaagaagatgttattgtggaatatggagcagatatctcctcaaaagactttggaagtggatttccggtgaaggatgggcggagaaagattctgccagaagaagaggaatatgcactttctggttggaatttgaataacatgcctgtcctggaacagtctgttcttgcacatattaatgtggacatctctggtatgaaagtgccgtggctctatgtgggaatgtgcttctcttctttttgctggcacattgaggatcactggagttattccatcaactacttgcactggggggagccaaagacatggtatggtgtgccatctcatgctgcagagcaactggaggaggtgatgagagagctggcccccgagttatttgaatcccagcctgatcttctgcatcagttagttaccatcatgaaccccaacgtgctaatggagcatggtgtgcctgtgtacaggaccaatcagtgtgctggcgagtttgttgtgacatttcctcgtgcctatcactctggatttaaccagggctacaactttgctgaagctgtgaacttctgtactgctgactggttgcccattggacgtcaatgtgtaaatcattaccgacgcctaaggcgccactgtgtcttttcacacgaggaactaattttcaagatggcagcagatccagaatgcttagatgtggggctggctgccatggtctgcaaagaattgactctcatgactgaagaagaaacacgattaagagagtctgttgtacagatgggtgtcctgatgtcagaagaagaagtgtttgaacttgttcctgatgatgagcggcagtgttcagcatgcagaaccacatgttttctctctgctctcacatgttcctgtaatcctgagcggcttgtatgtctctaccatccaactgatctgtgcccctgccccatgcagaagaaatgtcttagatatcgctacccattagaagacctcccttctctgctatatggtgtaaaagtcagggcacagtcctatgacacttgggtcagtcgtgttacagaagcattgtctgctaacttcaaccacaaaaaagatttgattgaattgcgagtaatgctggaagatgctgaggataggaaatacccagagaatgatctctttcgaaaactcagggatgctgtaaaagaagctgagacctgtgcttctgtggctcagctgcttctgagcaaaaagcagaaacacagacagagcccagatagtgggaggactcggaccaaactgacagtggaagaattgaaggcctttgtccaacaactttttagtcttccgtgtgtcatcagccaagctcggcaagtaaagaatctgctagatgatgtggaagagtttcatgaacgtgctcaggaggccatgatggatgaaaccccagattcttccaaactccagatgttgatagatatgggctctagtctctatgtggaactccctgaattaccacgactgaagcaagagctacaacaggctcggtggttggacgaagtaagactgaccttatcagatccgcaacaagtcactttggatgtcatgaagaagctgatagactctggggtagggttggcaccccaccatgctgtggagaaagcaatggctgaactacaggagctccttacagtctctgaacgatgggaagaaaaggctaaggtctgcctacaggcaagaccgaggcacagtgtggcaagtttagaaagcattgtgaatgaagccaagaacattccagcctttctacccaatgtgttgtccttgaaagaagccttacaaaaggctcgagaatggaccgctaaagtggaagctattcagagtggcagcaattacgcttatttggagcagcttgagagcttgtctgcgaaaggacgccctattcctgtgcgtcttgaagcactgccgcaagtggaatcacaggtagcagcagcacgggcatggagagaacggactgggcggacgtttcttaagaagaattctagccatacattgttacaggtgctgagcccccggaccgacattggtgtatatgggagtggcaaaaataggaggaaaaaagtaaaagaactaatagaaaaagaaaaagaaaaggatctggacctggagcctctgagtgatctggaggaaggattggaggaaaccagagatacagccatggtggtggcagttttcaaagaacgggagcaaaaagagattgaagccatgcattctctcagagcagccaacctagccaagatgacaatggtggaccgcatagaagaagtaaaattttgcatttgccgcaagacagccagtgggtttatgctacagtgtgagctctgcaaagactggttccataacagctgtgttcctcttcctaaatcaagttcccaaaaaaaaggatccagctggcaagctaaagaagtaaaattcctttgccctctttgtatgcggtctcgaaggcccaggctagagactattctgtcactcctggtatcccttcagaagttgcccgtacggttgcctgaaggagaggccctgcagtgtttgacagaacgtgctatgagttggcaagatagagcgcggcaggctctagccacagatgaactatcctctgccctggccaaactatctgtgttgagccagcgtatggtggaacaggcggctcgagaaaaaactgaaaagatcatcagtgcagaactccaaaaagcagctgccaatccagacttacagggacacttacctagtttccagcagtctgcttttaaccgggtggtgagcagtgtgtcatcttctcctcgacaaacaatggactatgatgatgaagaaacagactctgatgaagacattcgagagacatatggctacgacatgaaggacacagccagtgtgaagtcctctagtagtcttgaacccaatcttttttgtgatgaagagattcccatcaaatccgaggaggtggtgacccacatgtggacagcaccttcattttgtgcagagcatgcttattcttctgcttctaagagttgttctcaagtattttttgggaaaggttctagcaccccaaggaaacaacctcggaagagccctttggtgccccgaagtttggaacctccagtgctggagttgtcacctggagctaaggcacaactggaagaacttatgatggttggagatctcctggaagtatctctggacgagactcaacacatatggcggattttgcaggccacacacccaccctctgaagacagattcttgcatatcatggaggatgacagcatggaagagaaaccactaaaagtgaaaggaaaggactcttcagagaagaaacggaaacggaagctagaaaaggtagagcaactttttggagaaggaaaacagaagtccaaggagttaaagaaaatggacaaacctagaaagaagaaattaaaattaggtgcagacaaatcaaaggagctgaataaactggccaagaaactagcaaaagaagaagagagaaagaaaaagaaggagaaggctgctgcagccaaagttgaacttgtgaaagagagcactgaaaagaaaagagagaaaaaggtgctggacatcccctcaaagtatgactggtcaggagcagaggagtctgatgatgagaatgctgtgtgcgcagcacagaactgccaaaggccctgcaaggacaagggagttgtatttgtaacggaagaagagaagaataaaaaatattag

SEQ ID NO: 61 - protein, 1388 aa, Homosapien
MSRPPPTGKMPGAPETAPGDGAGASRQRKLEALIRDPRSPINVESLLDGLNSLVLDLDFPALRKNKNIDNFLNRYEKIVKKIRGLQMKAEDYDVVKVIGRGAFGEVQLVRHKASQKVYAMKLLSKFEMIKRSDSAFFWEERDIMAFANSPWVVQLFYAFQDDRYLYMVMEYMPGGDLVNLMSNYDVPEKWAKFYTAEVVLALDAIHSMGLIHRDVKPDNMLLDKHGHLKLADFGTCMKMDETGMVHCDTAVGTPDYISPEVLKSQGGDGFYGRECDWWSVGVFLYEMLVGDTPFYADSLVGTYSKIMDHKNSLCFPEDAEISKHAKNLICAFLTDREVRLGRNGVEEIRQHPFFKNDQWHWDNIRETAAPVVPELSSDIDSSNFDDIEDDKGDVETFPIPKAFVGNQLPFIGFTYYRENLLLSDSPSCRETDSIQSRKNEESQEIQKKLYTLEEHLSNEMQAKEELEQKCKSVNTRLEKTAKELEEEITLRKSVESALRQLEREKALLQHKNAEYQRKADHEADKKRNLENDVNSLKDQLEDLKKRNQNSQISTEKVNQLQRQLDETNALLRTESDTAARLRKTQAESSKQIQQLESNNRDLQDKNCLLETAKLKLEKEFINLQSALESERRDRTHGSEIINDLQGRICGLEEDLKNGKILLAKVELEKRQLQERFTDLEKEKSNMEIDMTYQLKVIQQSLEQEEAEHKATKARLADKNKIYESIEEAKSEAMKEMEKKLLEERTLKQKVENLLLEAEKRCSLLDCDLKQSQQKINELLKQKDVLNEDVRNLTLKIEQETQKRCLTQNDLKMQTQQVNTLKMSEKQLKQENNHLMEMKMNLEKQNAELRKERQDADGQMKELQDQLEAEQYFSTLYKTQVRELKEECEEKTKLGKELQQKKQELQDERDSLAAQLEITLTKADSEQLARSIAEEQYSDLEKEKIMKELEIKEMMARHKQELTEKDATIASLEETNRTLTSDVANLANEKEELNNKLKDVQEQLSRLKDEEISAAAIKAQFEKQLLTERTLKTQAVNKLAEIMNRKEPVKRGNDTDVRRKEKENRKLHMELKSEREKLTQQMIKYQKELNEMQAQIAEESQIRIELQMTLDSKDSDIEQLRSQLQALHIGLDSSSIGSGPGDAEADDGFPESRLEGWLSLPVRNNTKKFGWVKKYVIVSSKKILFYDSEQDKEQSNPYMVLDIDKLFHVRPVTQTDVYRADAKEIPRIFQILYANEGESKKEQEFPVEPVGEKSNYICHKGHEFIPTLYHFPTNCEACMKPLWHMFKPPPALECRRCHIKCHKDHMDKKEEIIAPCKVYYDISTAKNLLLLANSTEEQQKWVSRLVKKIPKKPPAPDPFARSSPRTSMKIQQNQSIRRPSRQLAPNKPS

SEQ ID NO: 62 - DNA, 4167 bp, Homosapien
atgagccggcccccgccgacggggaaaatgcccggcgcccccgagaccgcgccgggggacggggcaggcgcgagccgccagaggaagctggaggcgctgatccgagaccctcgctcccccatcaacgtggagagcttgctggatggcttaaattccttggtccttgatttagattttcctgctttgaggaaaaacaagaacatagataatttcttaaatagatatgagaaaattgtgaaaaaaatcagaggtctacagatgaaggcagaagactatgatgttgtaaaagttattggaagaggtgcttttggtgaagtgcagttggttcgtcacaaggcatcgcagaaggtttatgctatgaagcttcttagtaagtttgaaatgataaaaagatcagattctgcctttttttgggaagaaagagatattatggcctttgccaatagcccctgggtggttcagcttttttatgcctttcaagatgataggtatctgtacatggtaatggagtacatgcctggtggagaccttgtaaaccttatgagtaattatgatgtgcctgaaaaatgggccaaattttacactgctgaagttgttcttgctctggatgcaatacactccatgggtttaatacacagagatgtgaagcctgacaacatgctcttggataaacatggacatctaaaattagcagattttggcacgtgtatgaagatggatgaaacaggcatggtacattgtgatacagcagttggaacaccggattatatatcacctgaggttctgaaatcacaagggggtgatggtttctatgggcgagaatgtgattggtggtctgtaggtgttttcctttatgagatgctagtgggggatactccattttatgcggattcacttgtaggaacatatagcaaaattatggatcataagaattcactgtgtttccctgaagatgcagaaatttccaaacatgcaaagaatctcatctgtgctttcttaacagatagggaggtacgacttgggagaaatggggtggaagaaatcagacagcatcctttctttaagaatgatcagtggcattgggataacataagagaaacggcagctcctgtagtacctgaactcagcagtgacatagacagcagcaatttcgatgacattgaagatgacaaaggagatgtagaaaccttcccaattcctaaagcttttgttggaaatcagctgcctttcatcggatttacctactatagagaaaatttattattaagtgactctccatcttgtagagaaactgattccatacaatcaaggaaaaatgaagaaagtcaagagattcagaaaaaactgtatacattagaagaacatcttagcaatgagatgcaagccaaagaggaactggaacagaagtgcaaatctgttaatactcgcctagaaaaaacagcaaaggagctagaagaggagattaccttacggaaaagtgtggaatcagcattaagacagttagaaagagaaaaggcgcttcttcagcacaaaaatgcagaatatcagaggaaagctgatcatgaagcagacaaaaaacgaaatttggaaaatgatgttaacagcttaaaagatcaacttgaagatttgaaaaaaagaaatcaaaactctcaaatatccactgagaaagtgaatcaactccagagacaactggatgaaaccaatgctttactgcgaacagagtctgatactgcagcccggttaaggaaaacccaggcagaaagttcaaaacagattcagcagctggaatctaacaatagagatctacaagataaaaactgcctgctggagactgccaagttaaaacttgaaaaggaatttatcaatcttcagtcagctctagaatctgaaaggagggatcgaacccatggatcagagataattaatgatttacaaggtagaatatgtggcctagaagaagatttaaagaacggcaaaatcttactagcgaaagtagaactggagaagagacaacttcaggagagatttactgatttggaaaaggaaaaaagcaacatggaaatagatatgacataccaactaaaagttatacagcagagcctagaacaagaagaagctgaacataaggccacaaaggcacgactagcagataaaaataagatctatgagtccatcgaagaagccaaatcagaagccatgaaagaaatggagaagaagctcttggaggaaagaactttaaaacagaaagtggagaacctattgctagaagctgagaaaagatgttctctattagactgtgacctcaaacagtcacagcagaaaataaatgagctccttaaacagaaagatgtgctaaatgaggatgttagaaacctgacattaaaaatagagcaagaaactcagaagcgctgccttacacaaaatgacctgaagatgcaaacacaacaggttaacacactaaaaatgtcagaaaagcagttaaagcaagaaaataaccatctcatggaaatgaaaatgaacttggaaaaacaaaatgctgaacttcgaaaagaacgtcaggatgcagatgggcaaatgaaagagctccaggatcagctcgaagcagaacagtatttctcaaccctttataaaacacaagttagggagcttaaagaagaatgtgaagaaaagaccaaacttggtaaagaattgcagcagaagaaacaggaattacaggatgaacgggactctttggctgcccaactggagatcaccttgaccaaagcagattctgagcaactggctcgttcaattgctgaagaacaatattctgatttggaaaaagagaagatcatgaaagagctggagatcaaagagatgatggctagacacaaacaggaacttacggaaaaagatgctacaattgcttctcttgaggaaactaataggacactaactagtgatgttgccaatcttgcaaatgagaaagaagaattaaataacaaattgaaagatgttcaagagcaactgtcaagattgaaagatgaagaaataagcgcagcagctattaaagcacagtttgagaagcagctattaacagaaagaacactcaaaactcaagctgtgaataagttggctgagatcatgaatcgaaaagaacctgtcaagcgtggtaatgacacagatgtgcggagaaaagagaaggagaatagaaagctacatatggagcttaaatctgaacgtgagaaattgacccagcagatgatcaagtatcagaaagaactgaatgaaatgcaggcacaaatagctgaagagagccagattcgaattgaactgcagatgacattggacagtaaagacagtgacattgagcagctgcggtcacaactccaagccttgcatattggtctggatagttccagtataggcagtggaccaggggatgctgaggcagatgatgggtttccagaatcaagattagaaggatggctttcattgcctgtacgaaacaacactaagaaatttggatgggttaaaaagtatgtgattgtaagcagtaagaagattcttttctatgacagtgaacaagataaagaacaatccaatccttacatggttttagatatagacaagttatttcatgtccgaccagttacacagacagatgtgtatagagcagatgctaaagaaattccaaggatattccagattctgtatgccaatgaaggagaaagtaagaaggaacaagaatttccagtggagccagttggagaaaaatctaattatatttgccacaagggacatgagtttattcctactctttatcatttcccaaccaactgtgaggcttgtatgaagcccctgtggcacatgtttaagcctcctcctgctttggagtgccgccgttgccatattaagtgtcataaagatcatatggacaaaaaggaggagattatagcaccttgcaaagtatattatgatatttcaacggcaaagaatctgttattactagcaaattctacagaagagcagcagaagtgggttagtcggttggtgaaaaagatacctaaaaagcccccagctccagacccttttgcccgatcatctcctagaacttcaatgaagatacagcaaaaccagtctattagacggccaagtcgacagcttgccccaaacaaacctagctaa

SEQ ID NO: 63 - protein, 3259 aa, Homosapien
MLSRLSGLANVVLHELSGDDDTDQNMRAPLDPELHQESDMEFNNTTQEDVQERLAYAEQLVVELKDIIRQKDVQLQQKDEALQEERKAADNKIKKLKLHAKAKLTSLNKYIEEMKAQGGTVLPTEPQSEEQLSKHDKSSTEEEMEIEKIKHKLQEKEELISTLQAQLTQAQAEQPAQSSTEMEEFVMMKQQLQEKEEFISTLQAQLSQTQAEQAAQQVVREKDARFETQVRLHEDELLQLVTQADVETEMQQKLRVLQRKLEEHEESLVGRAQVVDLLQQELTAAEQRNQILSQQLQQMEAEHNTLRNTVETEREESKILLEKMELEVAERKLSFHNLQEEMHHLLEQFEQAGQAQAELESRYSALEQKHKAEMEEKTSHILSLQKTGQELQSACDALKDQNSKLLQDKNEQAVQSAQTIQQLEDQLQQKSKEISQFLNRLPLQQHETASQTSFPDVYNEGTQAVTEENIASLQKRVVELENEKGALLLSSIELEELKAENEKLSSQITLLEAQNRTGEADREVSEISIVDIANKRSSSAEESGQDVLENTFSQKHKELSVLLLEMKEAQEEIAFLKLQLQGKRAEEADHEVLDQKEMKQMEGEGIAPIKMKVFLEDTGQDFPLMPNEESSLPAVEKEQASTEHQSRTSEEISLNDAGVELKSTKQDGDKSLSAVPDIGQCHQDELERLKSQILELELNFHKAQEIYEKNLDEKAKEISNLNQLIEEFKKNADNNSSAFTALSEERDQLLSQVKELSMVTELRAQVKQLEMNLAEAERQRRLDYESQTAHDNLLTEQIHSLSIEAKSKDVKIEVLQNELDDVQLQFSEQSTLIRSLQSQLQNKESEVLEGAERVRHISSKVEELSQALSQKELEITKMDQLLLEKKRDVETLQQTIEEKDQQVTEISFSMTEKMVQLNEEKFSLGVEIKTLKEQLNLLSRAEEAKKEQVEEDNEVSSGLKQNYDEMSPAGQISKEELQHEFDLLKKENEQRKRKLQAALINRKELLQRVSRLEEELANLKDESKKEIPLSETERGEVEEDKENKEYSEKCVTSKCQEIEIYLKQTISEKEVELQHIRKDLEEKLAAEEQFQALVKQMNQTLQDKTNQIDLLQAEISENQAIIQKLITSNTDASDGDSVALVKETVVISPPCTGSSEHWKPELEEKILALEKEKEQLQKKLQEALTSRKAILKKAQEKERHLREELKQQKDDYNRLQEQFDEQSKENENIGDQLRQLQIQVRESIDGKLPSTDQQESCSSTPGLEEPLFKATEQHHTQPVLESNLCPDWPSHSEDASALQGGTSVAQIKAQLKEIEAEKVELELKVSSTTSELTKKSEEVFQLQEQINKQGLEIESLKTVSHEAEVHAESLQQKLESSQLQIAGLEHLRELQPKLDELQKLISKKEEDVSYLSGQLSEKEAALTKIQTEIIEQEDLIKALHTQLEMQAKEHDERIKQLQVELCEMKQKPEEIGEESRAKQQIQRKLQAALISRKEALKENKSLQEELSLARGTIERLTKSLADVESQVSAQNKEKDTVLGRLALLQEERDKLITEMDRSLLENQSLSSSCESLKLALEGLTEDKEKLVKEIESLKSSKIAESTEWQEKHKELQKEYEILLQSYENVSNEAERIQHVVEAVRQEKQELYGKLRSTEANKKETEKQLQEAEQEMEEMKEKMRKFAKSKQQKILELEEENDRLRAEVHPAGDTAKECMETLLSSNASMKEELERVKMEYETLSKKFQSLMSEKDSLSEEVQDLKHQIEDNVSKQANLEATEKHDNQTNVTEEGTQSIPGETEEQDSLSMSTRPTCSESVPSAKSANPAVSKDFSSHDEINNYLQQIDQLKERIAGLEEEKQKNKEFSQTLENEKNTLLSQISTKDGELKMLQEEVTKMNLLNQQIQEELSRVTKLKETAEEEKDDLEERLMNQLAELNGSIGNYCQDVTDAQIKNELLESEMKNLKKCVSELEEEKQQLVKEKTKVESEIRKEYLEKIQGAQKEPGNKSHAKELQELLKEKQQEVKQLQKDCIRYQEKISALERTVKALEFVQTESQKDLEITKENLAQAVEHRKKAQAELASFKVLLDDTQSEAARVLADNLKLKKELQSNKESVKSQMKQKDEDLERRLEQAEEKHLKEKKNMQEKLDALRREKVHLEETIGEIQVTLNKKDKEVQQLQENLDSTVTQLAAFTKSMSSLQDDRDRVIDEAKKWERKFSDAIQSKEEEIRLKEDNCSVLKDQLRQMSIHMEELKINISRLEHDKQIWESKAQTEVQLQQKVCDTLQGENKELLSQLEETRHLYHSSQNELAKLESELKSLKDQLTDLSNSLEKCKEQKGNLEGIIRQQEADIQNSKFSYEQLETDLQASRELTSRLHEEINMKEQKIISLLSGKEEAIQVAIAELRQQHDKEIKELENLLSQEEEENIVLEEENKKAVDKTNQLMETLKTIKKENIQQKAQLDSFVKSMSSLQNDRDRIVGDYQQLEERHLSIILEKDQLIQEAAAENNKLKEEIRGLRSHMDDLNSENAKLDAELIQYREDLNQVITIKDSQQKQLLEVQLQQNKELENKYAKLEEKLKESEEANEDLRRSFNALQEEKQDLSKEIESLKVSISQLTRQVTALQEEGTLGLYHAQLKVKEEEVHRLSALFSSSQKRIAELEEELVCVQKEAAKKVGEIEDKLKKELKHLHHDAGIMRNETETAEERVAELARDLVEMEQKLLMVTKENKGLTAQIQSFGRSMSSLQNSRDHANEELDELKRKYDASLKELAQLKEQGLLNRERDALLSETAFSMNSTEENSLSHLEKLNQQLLSKDEQLLHLSSQLEDSYNQVQSFSKAMASLQNERDHLWNELEKFRKSEEGKQRSAAQPSTSPAEVQSLKKAMSSLQNDRDRLLKELKNLQQQYLQINQEITELHPLKAQLQEYQDKTKAFQIMQEELRQENLSWQHELHQLRMEKSSWEIHERRMKEQYLMAISDKDQQLSHLQNLIRELRSSSSQTQPLKVQYQRQASPETSASPDGSQNLVYETELLRTQLNDSLKEIHQKELRIQQLNSNFSQLLEEKNTLSIQLCDTSQSLRENQQHYGDLLNHCAVLEKQVQELQAGPLNIDVAPGAPQEKNGVHRKSDPEELREPQQSFSEAQQQLCNTRQEVNELRKLLEEERDQRVAAENALSVAEEQIRRLEHSEWDSSRTPIIGSCGTQEQALLIDLTSNSCRRTRSGVGWKRVLRSLCHSRTRVPLLAAIYFLMIHVLLILCFTGHL

SEQ ID NO: 64 - DNA, 9780 bp, Homosapien
atgctgagccgattatcaggattagcaaatgttgttttgcatgaattatcaggagatgatgacactgatcagaatatgagggctcccctagaccctgaattacaccaagaatctgacatggaatttaataatactacacaagaagatgttcaggagcgcctggcttatgcagagcaattggtggtggagctaaaagatattattagacagaaggatgttcaactgcagcagaaagatgaagctctacaggaagagagaaaagctgctgataacaaaattaaaaaactaaaacttcatgcgaaggccaaattaacttctttgaataaatacatagaagaaatgaaagcacaaggagggactgttctgcctacagaacctcagtcagaggagcaactttccaagcatgacaagagttctacagaggaagagatggaaatagaaaagataaaacataagctccaggagaaggaggaactaatcagcactttgcaagcccagcttactcaggcacaggcagaacaacctgcacagagttctacagagatggaagaatttgtaatgatgaagcaacagctccaggagaaggaagaattcattagcactttacaagcccagctcagccagacacaggcagagcaagctgcacagcaggtggtccgagagaaagatgcccgctttgaaacacaagttcgtcttcatgaagatgagcttcttcagttagtaacccaggcagatgtggaaacagagatgcaacagaaattgagggtgctgcaaaggaagcttgaggaacacgaagaatccttggtgggccgtgctcaggtcgttgacttgctgcaacaggagctgactgctgctgagcagagaaaccagattctctctcagcagttacagcagatggaagctgagcataatactttgaggaacactgtggaaacagaaagagaggagtccaagattctactggaaaagatggaacttgaagtggcagagagaaaattatccttccataatctgcaggaagaaatgcatcatcttttagaacagtttgagcaagcaggccaagcccaggctgaactagagtctcggtatagtgctttggagcagaagcacaaagcagaaatggaagagaagacctctcatattttgagtcttcaaaagactggacaagagctgcagtctgcctgtgatgctctaaaggatcaaaattcaaagcttctccaagataagaatgaacaggcagttcagtcagcccagaccattcagcaactggaagatcagctccagcaaaaatccaaagaaattagccaatttctaaatagactgcccttgcaacaacatgaaacagcatctcagacttctttcccagatgtttataatgagggcacacaggcagtcactgaggagaatattgcttctttgcagaagagagtggtagaactagagaatgaaaagggagccttgctccttagttctatagagctggaggagctgaaagctgagaatgaaaaactgtcttctcagattactctcctagaggctcagaatagaactggggaggcagacagagaagtcagtgagatcagcattgttgatattgccaacaagaggagctcttctgctgaggaaagtggacaagatgttctagaaaacacattttctcagaaacataaagaattatcagttttattgttggaaatgaaagaagctcaagaggaaattgcatttcttaaattacagctccagggaaaaagggctgaggaagcagatcatgaggtccttgaccagaaagaaatgaaacagatggagggtgagggaatagctccaattaaaatgaaagtatttcttgaagatacagggcaagattttcccttaatgccaaatgaagagagcagtcttccagcagttgaaaaagaacaggcgagcactgaacatcaaagtagaacatctgaggaaatatctttaaatgatgctggagtagaattgaaatcaacaaagcaggatggtgataaatccctttctgctgtaccagatattggtcagtgtcatcaggatgagttggaaaggttaaaaagtcaaattttggagctcgagctaaactttcataaagcacaagaaatctatgagaaaaatttagatgagaaagctaaggaaattagcaacctaaaccagttgattgaggagtttaagaaaaatgctgacaacaacagcagtgcattcactgctttgtctgaagaaagagaccagcttctctctcaggtgaaggaacttagcatggtaacagaattgagggctcaggtaaagcaactggaaatgaaccttgcagaagcagaaaggcaaagaagacttgattatgaaagccaaactgcccatgacaacctgctcactgaacagatccatagtctcagcatagaagccaaatctaaagatgtgaaaattgaagttttacagaatgaactggatgatgtgcagcttcagttttctgagcagagtaccctgataagaagcctgcaaagccagctgcaaaataaggaaagtgaagtgcttgagggggcagaacgtgtaaggcatatctcaagtaaagtggaagaactgtcccaggctctttcacagaaggaacttgaaataacaaaaatggatcagctcttactagagaaaaagagagatgtggaaaccctccaacaaaccatcgaggagaaggatcaacaagtgacagaaatcagctttagtatgactgagaaaatggttcagcttaatgaagagaagttttctcttggggttgaaattaagactcttaaagaacagctaaatttattatccagagctgaggaagcaaaaaaagagcaggtggaagaagataatgaagtttcttctggccttaaacaaaattatgatgagatgagcccagcaggacaaataagtaaggaagaacttcagcatgaatttgaccttctgaagaaagaaaatgagcagagaaagagaaagctccaggcagctcttattaacagaaaggagcttctgcaaagagtcagtagattggaagaagaattagccaacttgaaagatgaatctaagaaagaaatcccactcagtgagactgagaggggagaagtggaagaagataaagaaaacaaagaatactcagaaaaatgtgtgacttctaagtgccaagaaatagaaatttatttaaaacagacaatatctgagaaagaagtggaactacagcatataaggaaggatttggaagaaaagctggcagctgaagagcaattccaggctctggtcaaacagatgaatcagaccttgcaagataaaacaaaccaaatagatttgctccaagcagaaatcagtgaaaaccaagcaattatccagaagttaatcacaagtaacacggatgcaagtgatggggactccgtagcacttgtaaaggaaacagtggtgataagtccaccttgtacaggtagtagtgaacactggaaaccagaactagaagaaaagatactggcccttgaaaaagaaaaggagcaacttcaaaagaagctacaggaagccttaacctcccgcaaggcaattcttaaaaaggcacaggagaaagaaagacatctcagggaggagctaaagcaacagaaagatgactataatcgcttgcaagaacagtttgatgagcaaagcaaggaaaatgagaatattggagaccagctaaggcaactccagattcaagtaagggaatccatagacggaaaactcccaagcacagaccagcaggaatcgtgttcttccactccaggtttagaagaacctttattcaaagccacagaacagcatcacactcaacctgttttagagtccaacttgtgcccagactggccttctcattctgaagatgcgagtgctctgcagggcggaacttctgttgcccagattaaggcccagctgaaggaaatagaggctgagaaagtagagttagaattgaaagttagttctacaacaagtgagcttactaaaaaatcagaagaggtatttcagttacaagagcagataaataaacagggtttagaaatcgagagtctaaagacagtatcccatgaagctgaagtccatgccgaaagcctgcagcagaaattggaaagcagccaactacaaattgctggcctagaacatctaagagaattgcaacctaaactggatgaactgcaaaaactcataagcaaaaaggaagaagacgttagctacctttctggacaacttagtgagaaagaagcagctctcactaaaatacagacagagataatagaacaagaagatttaattaaggctctgcatacacagctagaaatgcaagccaaagagcatgatgagaggataaagcagctacaggtggaactttgtgaaatgaagcaaaaaccagaagagattggagaagaaagtagagcaaagcaacaaatacaaaggaaactgcaagctgcccttatttcccgaaaagaagcactaaaagaaaacaaaagtctccaagaggaattgtctttggccagaggtaccattgaacgtctcaccaagtctctggcagatgtggaaagccaagtttctgctcaaaataaagaaaaagatacggtcttaggaaggttagctcttcttcaagaagaaagagacaaactcattacagaaatggacaggtctttattggaaaatcagagtctcagcagctcctgtgaaagtctaaaactagctctagagggtcttactgaagacaaggaaaagttagtgaaggaaattgaatctttgaaatcttctaagattgcagaaagtactgagtggcaagagaaacacaaggagctacaaaaagagtatgaaattcttctgcagtcctatgagaatgttagtaatgaagcagaaaggattcagcatgtggtggaagctgtgaggcaagagaaacaagaactgtatggcaagttaagaagcacagaggcaaacaagaaggagacagaaaagcagttgcaggaagctgagcaagaaatggaggaaatgaaagaaaagatgagaaagtttgctaaatctaaacagcagaaaatcctagagctggaagaagagaatgaccggcttagggcagaggtgcaccctgcaggagatacagctaaagagtgtatggaaacacttctttcttccaatgccagcatgaaggaagaacttgaaagggtcaaaatggagtatgaaaccctttctaagaagtttcagtctttaatgtctgagaaagactctctaagtgaagaggttcaagatttaaagcatcagatagaagataatgtatctaaacaagctaacctagaggccaccgagaaacatgataaccaaacgaatgtcactgaagagggaacacagtctataccaggtgagactgaagagcaagactctctgagtatgagcacaagacctacatgttcagaatcggttccatcagcgaagagtgccaaccctgctgtaagtaaggatttcagctcacatgatgaaattaataactacctacagcagattgatcagctcaaagaaagaattgctggattagaggaggagaagcagaaaaacaaggaatttagccagactttagaaaatgagaaaaataccttactgagtcagatatcaacaaaggatggtgaactaaaaatgcttcaggaggaagtaaccaaaatgaacctgttaaatcagcaaatccaagaagaactctccagagttaccaaactaaaggagacagcagaagaagagaaagatgatttggaagagaggcttatgaatcaattagcagaacttaatggaagcattgggaattactgtcaggatgttacagatgcccaaataaaaaatgagctattggaatctgaaatgaagaaccttaaaaagtgtgtgagtgaattggaagaagaaaagcagcagttagtcaaggaaaaaactaaggtggaatcagaaatacgaaaggaatatttggagaaaatacaaggtgctcagaaagaacccggaaataaaagccatgcaaaggaacttcaggaactgttaaaagaaaaacaacaagaagtaaagcagctacagaaggactgcatcaggtatcaagagaaaattagtgctctggagagaactgttaaagctctagaatttgttcaaactgaatctcaaaaagatttggaaataaccaaagaaaatctggctcaagcagttgaacaccgcaaaaaggcacaagcagaattagctagcttcaaagtcctgctagatgacactcaaagtgaagcagcaagggtcctagcagacaatctcaagttgaaaaaggaacttcagtcaaataaagaatcagttaaaagccagatgaaacaaaaggatgaagatcttgagcgaagactggaacaggcagaagagaagcacctgaaagagaagaagaatatgcaagagaaactggatgctttgcgcagagaaaaagtccacttggaagagacaattggagagattcaggttactttgaacaagaaagacaaggaagttcagcaacttcaggaaaacttggacagtactgtgacccagcttgcagcctttactaagagcatgtcttccctccaggatgatcgtgacagggtgatagatgaagctaagaaatgggagaggaagtttagtgatgcgattcaaagcaaagaagaagaaattagactcaaagaagataattgcagtgttctaaaggatcaacttagacagatgtccatccatatggaagaattaaagattaacatttccaggcttgaacatgacaagcagatttgggagtccaaggcccagacagaggtccagcttcagcagaaggtctgtgatactctacagggggaaaacaaagaacttttgtcccagctagaagagacacgccacctataccacagttctcagaatgaattagctaagttggaatcagaacttaagagtctcaaagaccagttgactgatttaagtaactctttagaaaaatgtaaggaacaaaaaggaaacttggaagggatcataaggcagcaagaggctgatattcaaaattctaagttcagttatgaacaactggagactgatcttcaggcctccagagaactgaccagtaggctgcatgaagaaataaatatgaaagagcaaaagattataagcctgctttctggcaaggaagaggcaatccaagtagctattgctgaactgcgtcagcaacatgataaagaaattaaagagctggaaaacctgctgtcccaggaggaagaggagaatattgttttagaagaggagaacaaaaaggctgttgataaaaccaatcagcttatggaaacactgaaaaccatcaaaaaggaaaacattcagcaaaaggcacagttggattcctttgttaaatccatgtcttctctccaaaatgatcgagaccgcatagtgggtgactatcaacagctggaagagcgacatctctctataatcttggaaaaagaccaactcatccaagaggctgctgcagagaataataagcttaaagaagaaatacgaggcttgagaagtcatatggatgatctcaattctgagaatgccaagctagatgcagaactgatccaatatagagaagacctgaaccaagtgataacaataaaggacagccaacaaaagcagcttcttgaagttcaacttcagcaaaataaggagctggaaaataaatatgctaaattagaagaaaagctgaaggaatctgaggaagcaaatgaggatctgcggaggtcctttaatgccctacaagaagagaaacaagatttatctaaagagattgagagtttgaaagtatctatatcccagctaacaagacaagtaacagccttgcaagaagaaggtactttaggactctatcatgcccagttaaaagtaaaagaagaagaggtacacaggttaagtgctttgttttcctcctctcaaaagagaattgcagaactggaagaagaattggtttgtgttcaaaaggaagctgccaagaaggtaggtgaaattgaagataaactgaagaaagaattaaagcatcttcatcatgatgcagggataatgagaaatgaaactgaaacagcagaagagagagtggcagagctagcaagagatttggtggagatggaacagaaattactcatggtcaccaaagaaaataaaggtctcacagcacaaattcagtcttttggaaggtctatgagttccttgcaaaatagtagagatcatgccaatgaggaacttgatgaactgaaaaggaaatatgatgccagtctgaaggaattggcacagttgaaagaacagggactcttaaacagagagagagatgctcttctttctgaaaccgccttttcaatgaactccactgaggagaatagcttgtctcaccttgagaaacttaaccaacagctcctatccaaagatgagcaattgcttcacttgtcctcacaactagaagattcttataaccaagtgcagtccttttccaaggctatggccagtctgcagaatgagagagatcacctgtggaatgagctggagaaatttcgaaagtcagaggaagggaagcagaggtctgcagctcagccttccaccagcccagctgaagtacagagtttaaaaaaagctatgtcttcactccaaaatgacagagacagactactgaaggaattgaagaatctgcagcagcaatacttacagattaatcaagagatcactgagttacatccactgaaggctcaacttcaggagtatcaagataagacaaaagcatttcagattatgcaagaagagctcaggcaggaaaacctctcctggcagcatgagctgcatcagctcaggatggagaagagttcctgggaaatacatgagaggagaatgaaggaacagtaccttatggctatctcagataaagatcagcagctcagtcatctgcagaatcttataagggaattgaggtcttcttcctcccagactcagcctctcaaagtgcaataccaaagacaggcatccccagagacatcagcttccccagatgggtcacaaaatctggtttatgagacagaacttctcaggacccagctcaatgacagcttaaaggaaattcaccaaaaggagttaagaattcagcaactgaacagcaacttctctcagctactggaagagaaaaacaccctttccattcagctctgcgataccagtcagagtcttcgtgagaaccagcagcactatggtgaccttttaaatcactgtgcagtcttggagaagcaggttcaagagctgcaggcggggccactaaatatagatgttgctccaggagctccccaggaaaagaatggagttcacagaaagagtgaccctgaggaactaagggaaccgcagcaaagcttttctgaagctcagcagcagctatgcaacaccagacaggaagtgaatgaattaaggaagctgctggaagaagaacgagaccaaagagtggctgctgagaatgctctctctgtggccgaggagcagatcagacggttagagcacagtgaatgggactcttcccggactcctatcattggctcctgtggcactcaggagcaggcactgttaatagatcttacaagcaacagttgtcgaaggacccggagtggcgttggatggaagcgagtcctgcgttcactctgtcattcacggacccgagtgccacttctagcagccatctactttctaatgattcatgtcctgctcattctgtgttttacgggccatctatag

SEQ ID NO: 65 - protein, 255 aa, Homosapien
MAFRQALQLAACGLAGGSAAVLFSAVAVGKPRAGGDAEPRPAEPPAWAGGARPGPGVWDPNWDRREPLSLINVRKRNVESGEEELASKLDHYKAKATRHIFLIRHSQYHVDGSLEKDRTLTPLGREQAELTGLRLASLGLKFNKIVHSSMTRAIETTDIISRHLPGVCKVSTDLLREGAPIEPDPPVSHWKPEAVQYYEDGARIEAAFRNYIHRADARQEEDSYEIFICHANVIRYIVCSIPPLLSAGDFVVLGS

SEQ ID NO: 66 - DNA, 768 bp, Homosapien
atggcgttccggcaggcgctgcagctggcggcctgcgggctggccgggggctcggccgccgtgctcttctcggccgtggcggtagggaagccgcgcgcaggcggggacgcggagccacgcccggctgagccgccggcctgggcggggggcgcgcggccgggccccggtgtctgggaccccaactgggacaggcgagaaccactgtctctgatcaacgtgcggaagaggaacgtggaatctggggaagaagagctggcgtccaagctggaccactacaaagccaaggccacgcggcacatcttcctcatcaggcattcccagtaccacgtggatggctccctggagaaggaccgcactctgaccccgctgggtcgggagcaggctgaactcactgggctccgcctggcaagcttggggttgaagtttaataaaatcgtccattcgtctatgacgcgcgccatagagaccaccgatatcatcagccggcacctgccaggcgtctgcaaagtcagcacagatctgctgcgggaaggcgcccccatcgagccagacccgcccgtgtctcattggaagccggaagctgtgcagtattacgaagacggagcccggatcgaggccgccttccggaactacatccaccgcgcagatgccaggcaggaggaggacagttacgaaatcttcatctgtcacgccaacgtcatccgctacatcgtgtgcagcatcccgccgctgttgtccgctggggattttgtggttctggggtcctga

SEQ ID NO: 67 - protein, 188 aa, Homosapien [sequence omitted]

SEQ ID NO: 68 - DNA, 567 bp, Homosapien
atggcgctggccatgctggtcttggtggtttcgccgtggtctgcggcccggggagtgcttcgaaactactgggagcgactgctacggaagcttccgcagagccggccgggctttcccagtcctccgtggggaccagcattagcagtacagggcccagccatgtttacagagccagcaaatgataccagtggaagtaaagagaattccagccttttggacagtatcttttggatggcagctcccaaaaatagacgcaccattgaagttaaccggtgtaggagaagaaatccgcagaagcttattaaagttaagaacaacatagacgtttgtcctgaatgtggtcacctgaaacagaaacatgtcctttgtgcctactgctatgaaaaggtgtgcaaggagactgcagaaatcagacgacagatagggaagcaagaagggggcccttttaaggctcccaccatagagactgtggtgctgtacacaggagagacaccgtctgaacaagatcagggcaagaggatcattgaacgagacagaaagcgaccatcctggttcacccagaattga

SEQ ID NO: 69 - protein, 1388 aa, Homosapien
MAPGCKTELRSVTNGQSNQPSNEGDAIKVFVRIRPPAERSGSADGEQNLCLSVLSSTSLRLHSNPEPKTFTFDHVADVDTTQESVFATVAKSIVESCMSGYNGTIFAYGQTGSGKTFTMMGPSESDNFSHNLRGVIPRSFEYLFSLIDREKEKAGAGKSFLCKCSFIEIYNEQIYDLLDSASAGLYLREHIKKGVFVVGAVEQVVTSAAEAYQVLSGGWRNRRVASTSMNRESSRSHAVFTITIESMEKSNEIVNIRTSLLNLVDLAGSERQKDTHAEGMRLKEAGNINRSLSCLGQVITALVDVGNGKQRHVCYRDSKLTFLLRDSLGGNAKTAIIANVHPGSRCFGETLSTLNFAQRAKLIKNKAVVNEDTQGNVSQLQAEVKRLKEQLAELASGQTPPESFLTRDKKKTNYMEYFQEAMLFFKKSEQEKKSLIEKVTQLEDLTLKKEKFIQSNKMIVKFREDQIIRLEKLHKESRGGFLPEEQDRLLSELRNEIQTLREQIEHHPRVAKYAMENHSLREENRRLRLLEPVKRAQEMDAQTIAKLEKAFSEISGMEKSDKNQQGFSPKAQKEPCLFANTEKLKAQLLQIQTELNNSKQEYEEFKELTRKRQLELESELQSLQKANLNLENLLEATKACKRQEVSQLNKIHAETLKIITTPTKAYQLHSRPVPKLSPEMGSFGSLYTQNSSILDNDILNEPVPPEMNEQAFEAISEELRTVQEQMSALQAKLDEEEHKNLKLQQHVDKLEHHSTQMQELFSSERIDWTKQQEELLSQLNVLEKQLQETQTKNDFLKSEVHDLRVVLHSADKELSSVKLEYSSFKTNQEKEFNKLSERHMHVQLQLDNLRLENEKLLESKACLQDSYDNLQEIMKFEIDQLSRNLQNFKKENETLKSDLNNLMELLEAEKERNNKLSLQFEEDKENSSKEILKVLEAVRQEKQKETAKCEQQMAKVQKLEESLLATEKVISSLEKSRDSDKKVVADLMNQIQELRTSVCEKTETIDTLKQELKDINCKYNSALVDREESRVLIKKQEVDILDLKETLRLRILSEDIERDMLCEDLAHATEQLNMLTEASKKHSGLLQSAQEELTKKEALIQELQHKLNQKKEEVEQKKNEYNFKMRQLEHVMDSAAEDPQSPKTPPHFQTHLAKLLETQEQEIEDGRASKTSLEHLVTKLNEDREVKNAEILRMKEQLREMENLRLESQQLIEKNWLLQGQLDDIKRQKENSDQNHPDNQQLKNEQEESIKERLAKSKIVEEMLKMKADLEEVQSALYNKEMECLRMTDEVERTQTLESKAFQEKEQLRSKLEEMYEERERTSQEMEMLRKQVECLAEENGKLVGHQNLHQKIQYVVRLKKENVRLAEETEKLRAENVFLKEKKRSES

SEQ ID NO: 70 - DNA, 4167 bp, Homosapien
atggcacccggctgcaaaactgagttacgcagcgtgacaaatggtcagtctaaccaaccaagtaatgaaggtgatgccatcaaagtttttgtgcgaattcgtcctcctgcagaaagatctgggtcagctgatggagagcagaacttatgcttatctgtgctgtcctccacgagtctccggctgcactccaaccctgagcccaagaccttcacgtttgatcatgttgcagatgtggataccactcaggaatctgtatttgcaactgtggctaaaagcattgtggagtcttgcatgagcggttataatggtaccatctttgcatatggacagactggctcagggaagacatttactatgatgggaccatctgaatctgataatttttctcataacctgagaggagtaatcccacgaagttttgaatatttgttttccttaattgatcgtgaaaaagaaaaggctggagctggaaagagtttcctttgtaagtgttcctttattgaaatctacaacgagcagatatatgatctactggactctgcatcggctggactgtacttaagggagcatatcaagaagggagtctttgttgttggtgcggtggagcaggtggtaacctcagctgctgaagcctatcaggtgctgtctggaggatggaggaatagacgtgtggcatcaacatcaatgaacagagaatcgtctaggtctcatgccgtctttacaattacaatagagtcaatggagaaaagtaatgagattgtgaatatacggacctccctactcaacctggtggatttagcaggatctgaaaggcaaaaagatacccatgcagaagggatgagattgaaggaagcaggtaacataaatcgatcattgagctgcctgggccaagtgattacagcacttgtcgacgtgggtaatggaaaacagagacatgtttgctacagagactccaaacttaccttcttactacgggattcccttggaggtaatgccaaaacagccataattgcaaatgttcatcctggatccaggtgttttggggaaaccctatcaacacttaactttgctcaaagagccaagctgattaaaaacaaggcagtagtaaatgaagacacccaaggaaatgtgagccagctccaagctgaagtgaagaggctcaaagaacaactggcggagcttgcttcaggacagacaccaccagaaagcttcctgaccagagacaaaaagaagactaactatatggagtatttccaggaagcaatgttattctttaagaaatctgaacaggaaaagaagtctctgatagaaaaagttacccaattagaagacctcaccctcaaaaaggaaaaatttattcaatctaataaaatgattgtgaaattccgagaggatcaaataatacgcttggaaaagctccacaaggaatcccggggaggttttctgcctgaggagcaggatcgtttgctctcagaattaaggaatgagattcaaactctgcgagaacaaatagagcaccaccccagagttgcaaagtatgctatggaaaatcattccctcagggaggagaatagaagactgagattattagagcctgtgaaaagagctcaagaaatggatgcccagaccattgcaaaactagaaaaagctttctctgaaataagtggcatggagaaaagtgacaaaaatcagcaaggattttcacctaaagctcagaaagagccatgtttgtttgcaaacactgagaagttaaaagcacaactcctgcaaattcagacagagctgaataattcaaagcaagaatatgaagaattcaaagaacttactaggaaaaggcagctagaattggaatcagagcttcagtctttgcaaaaagcgaaccttaatcttgaaaaccttttggaagcaacaaaagcctgcaagcggcaagaagtttctcagctgaataaaattcatgctgaaacacttaagattataactacaccaaccaaggcctaccaacttcattcccgaccagtaccaaaattaagccctgaaatgggaagctttggctctctatacactcagaattctagcatattagataatgatatattaaatgagccagttcctcctgagatgaatgaacaagcttttgaggccatttctgaagagcttagaacagtgcaggaacaaatgagtgctcttcaagccaaactggatgaagaagagcataaaaacctaaagcttcagcagcatgttgacaaactggaacatcattctacccaaatgcaggagcttttctcatcagaaagaattgattggaccaaacagcaggaagagcttctctcacagttgaatgtccttgaaaagcagcttcaagagactcaaactaaaaatgactttttgaaaagtgaggtacatgacctgcgagtagtccttcattctgctgacaaggagctttcttcagtgaaattggaatatagttcattcaaaacgaatcaggagaaagaattcaacaaactttctgaaagacacatgcatgtacagcttcaattagataatctcaggttagaaaacgaaaagctgcttgagagcaaagcctgcctacaggattcctatgacaacttacaagaaataatgaaatttgagattgaccaactttcaagaaacctccaaaacttcaaaaaagaaaatgaaactctgaaatctgatctgaataatttgatggagcttcttgaggcagaaaaagaacgcaataacaaattatcattacagtttgaagaagataaagaaaacagttctaaagaaatcttaaaagttcttgaggctgtacgtcaggagaaacagaaagagacggccaagtgtgagcagcagatggcaaaagtacagaaactagaagagagcttgcttgctactgaaaaagtgatcagttccctggaaaagtctagagattctgataagaaagttgtagctgacctcatgaaccagatccaggagctaagaacatcggtctgtgagaaaacagaaactatagacaccctgaaacaagaactgaaggacataaattgcaaatacaactctgctttggttgacagagaagagagcagagtgttgatcaagaagcaggaagtggatattctggatctgaaagaaacccttaggctgagaatactttctgaggacatagagagggatatgctctgtgaggacctggctcatgccactgagcagctgaacatgctcacagaggcctcaaaaaaacactcggggctgctgcagtctgcccaggaagaactgaccaagaaggaagccctgattcaggaacttcagcacaagctaaaccaaaagaaagaggaagtagaacagaagaagaatgaatataacttcaaaatgaggcaactagaacatgtgatggattctgctgctgaggatccccagagtcctaagacaccacctcactttcaaacacatttggcaaaactcctggaaacacaagaacaagagatagaagatggaagagcctctaagacttctttggaacaccttgtaacaaagctaaatgaagacagagaagtcaaaaatgctgaaatcctcagaatgaaggagcagttgcgtgaaatggaaaacctacgcctggaaagtcagcagttaatagagaaaaactggctcctgcaaggtcagctggatgatattaaaagacaaaaggaaaacagtgatcagaatcatccagataatcaacagctgaagaatgaacaagaagaaagtatcaaagaaagacttgcaaaaagtaaaatagttgaagaaatgctgaaaatgaaagcagacctagaagaagtccaaagtgccctttacaacaaagagatggaatgccttagaatgactgatgaagtcgaacgaacccaaactttggagtctaaagcattccaggaaaaagaacaactgagatcaaagctggaagaaatgtatgaagaaagagagagaacatcccaggagatggaaatgttaaggaagcaggtggagtgtcttgctgaggaaaatggaaagttggtaggtcaccaaaatttgcatcagaagattcagtacgtagtgcgactaaagaaggaaaatgtcaggcttgctgaggagacagaaaagttgcgtgccgaaaatgtatttttaaaagaaaagaaaagaagtgaatcttga

SEQ ID NO: 71 - protein, 3114 aa, Homosapien
MSWALEEWKEGLPTRALQKIQELEGQLDKLKKEKQQRQFQLDSLEAALQKQKQKVENEKTEGTNLKRENQRLMEICESLEKTKQKISHELQVKESQVNFQEGQLNSGKKQIEKLEQELKRCKSELERSQQAAQSADVSLNPCNTPQKIFTTPLTPSQYYSGSKYEDLKEKYNKEVEERKRLEAEVKALQAKKASQTLPQATMNHRDIARHQASSSVFSWQQEKTPSHLSSNSQRTPIRRDFSASYFSGEQEVTPSRSTLQIGKRDANSSFFDNSSSPHLLDQLKAQNQELRNKINELELRLQGHEKEMKGQVNKFQELQLQLEKAKVELIEKEKVLNKCRDELVRTTAQYDQASTKYTALEQKLKKLTEDLSCQRQNAESARCSLEQKIKEKEKEFQEELSRQQRSFQTLDQECIQMKARLTQELQQAKNMHNVLQAELDKLTSVKQQLENNLEEFKQKLCRAEQAFQASQIKENELRRSMEEMKKENNLLKSHSEQKAREVCHLEAELKNIKQCLNQSQNFAEEMKAKNTSQETMLRDLQEKINQQENSLTLEKLKLAVADLEKQRDCSQDLLKKREHHIEQLNDKLSKTEKESKALLSALELKKKEYEELKEEKTLFSCWKSENEKLLTQMESEKENLQSKINHLETCLKTQQIKSHEYNERVRTLEMDRENLSVEIRNLHNVLDSKSVEVETQKLAYMELQQKAEFSDQKHQKEIENMCLKTSQLTGQVEDLEHKLQLLSNEIMDKDRCYQDLHAEYESLRDLLKSKDASLVTNEDHQRSLLAFDQQPAMHHSFANIIGEQGSMPSERSECRLEADQSPKNSAILQNRVDSLEFSLESQKQMNSDLQKQCEELVQIKGEIEENLMKAEQMHQSFVAETSQRISKLQEDTSAHQNVVAETLSALENKEKELQLLNDKVETEQAEIQELKKSNHLLEDSLKELQLLSETLSLEKKEMSSIISLNKREIEELTQENGTLKEINASLNQEKMNLIQKSESFANYIDEREKSISELSDQYKQEKLILLQRCEETGNAYEDLSQKYKAAQEKNSKLECLLNECTSLCENRKNELEQLKEAFAKEHQEFLTKLAFAEERNQNLMLELETVQQALRSEMTDNQNNSKSEAGGLKQEIMTLKEEQNKMQKEVNDLLQENEQLMKVMKTKHECQNLESEPIRNSVKERESERNQCNFKPQMDLEVKEISLDSYNAQLVQLEAMLRNKELKLQESEKEKECLQHELQTIRGDLETSNLQDMQSQEISGLKDCEIDAEEKYISGPHELSTSQNDNAHLQCSLQTTMNKLNELEKICEILQAEKYELVTELNDSRSECITATRKMAEEVGKLLNEVKILNDDSGLLHGELVEDIPGGEFGEQPNEQHPVSLAPLDESNSYEHLTLSDKEVQMHFAELQEKFLSLQSEHKILHDQHCQMSSKMSELQTYVDSLKAENLVLSTNLRNFQGDLVKEMQLGLEEGLVPSLSSSCVPDSSSLSSLGDSSFYRALLEQTGDMSLLSNLEGAVSANQCSVDEVFCSSLQEENLTRKETPSAPAKGVEELESLCEVYRQSLEKLEEKMESQGIMKNKEIQELEQLLSSERQELDCLRKQYLSENEQWQQKLTSVTLEMESKLAAEKKQTEQLSLELEVARLQLQGLDLSSRSLLGIDTEDAIQGRNESCDISKEHTSETTERTPKHDVHQICDKDAQQDLNLDIEKITETGAVKPTGECSGEQSPDTNYEPPGEDKTQGSSECISELSFSGPNALVPMDFLGNQEDIHNLQLRVKETSNENLRLLHVIEDRDRKVESLLNEMKELDSKLHLQEVQLMTKIEACIELEKIVGELKKENSDLSEKLEYFSCDHQELLQRVETSEGLNSDLEMHADKSSREDIGDNVAKVNDSWKERFLDVENELSRIRSEKASIEHEALYLEADLEVVQTEKLCLEKDNENKQKVIVCLEEELSVVTSERNQLRGELDTMSKKTTALDQLSEKMKEKTQELESHQSECLHCIQVAEAEVKEKTELLQTLSSDVSELLKDKTHLQEKLQSLEKDSQALSLTKCELENQIAQLNKEKELLVKESESLQARLSESDYEKLNVSKALEAALVEKGEFALRLSSTQEEVHQLRRGIEKLRVRIEADEKKQLHIAEKLKERERENDSLKDKVENLERELQMSEENQELVILDAENSKAEVETLKTQIEEMARSLKVFELDLVTLRSEKENLTKQIQEKQGQLSELDKLLSSFKSLLEEKEQAEIQIKEESKTAVEMLQNQLKELNEAVAALCGDQEIMKATEQSLDPPIEEEHQLRNSIEKLRARLEADEKKQLCVLQQLKESEHHADLLKGRVENLERELEIARTNQEHAALEAENSKGEVETLKAKIEGMTQSLRGLELDVVTIRSEKENLTNELQKEQERISELEIINSSFENILQEKEQEKVQMKEKSSTAMEMLQTQLKELNERVAALHNDQEACKAKEQNLSSQVECLELEKAQLLQGLDEAKNNYIVLQSSVNGLIQEVEDGKQKLEKKDEEISRLKNQIQDQEQLVSKLSQVEGEHQLWKEQNLELRNLTVELEQKIQVLQSKNASLQDTLEVLQSSYKNLENELELTKMDKMSFVEKVNKMTAKETELQREMHEMAQKTAELQEELSGEKNRLAGELQLLLEEIKSSKDQLKELTLENSELKKSLDCMHKDQVEKEGKVREEIAEYQLRLHEAEKKHQALLLDTNKQYEVEIQTYREKLTSKEECLSSQKLEIDLLKSSKEELNNSLKATTQILEELKKTKMDNLKYVNQLKKENERAQGKMKLLIKSCKQLEEEKEILQKELSQLQAAQEKQKTGTVMDTKVDELTTEIKELKETLEEKTKEADEYLDKYCSLLISHEKLEKAKEMLETQVAHLCSQQSKQDSRGSPLLGPVVPGPSPIPSVTEKRLSSGQNKASGKRQRSSGIWENGRGPTPATPESFSKKSKKAVMSGIHPAEDTEGTEFEPEGLPEVVKKGFADIPTGKTSPYILRRTTMATRTSPRLAAQKLALSPLSLGKENLAESSKPTAGGSRSQKVKVAQRSPVDSGTILREPTTKSVPVNNLPERSPTDSPREGLRVKRGRLVPSPKAGLESNGSENCKVQ

SEQ ID NO: 72 - DNA, 9345 bp, Homosapien
atgagctgggctttggaagaatggaaagaagggctgcctacaagagctcttcagaaaattcaagagcttgaaggacagcttgacaaactgaagaaggaaaagcagcaaaggcagtttcagcttgacagtctcgaggctgcgctgcagaagcaaaaacagaaggttgaaaatgaaaaaaccgagggtacaaacctgaaaagggagaatcaaagattgatggaaatatgtgaaagtctggagaaaactaagcagaagatttctcatgaacttcaagtcaaggagtcacaagtgaatttccaggaaggacaactgaattcaggcaaaaaacaaatagaaaaactggaacaggaacttaaaaggtgtaaatctgagcttgaaagaagccaacaagctgcgcagtctgcagatgtctctctgaatccatgcaatacaccacaaaaaatttttacaactccactaacaccaagtcaatattatagtggttccaagtatgaagatctaaaagaaaaatataataaagaggttgaagaacgaaaaagattagaggcagaggttaaagccttgcaggctaaaaaagcaagccagactcttccacaagccaccatgaatcaccgcgacattgcccggcatcaggcttcatcatctgtgttctcatggcagcaagagaagaccccaagtcatctttcatctaattctcaaagaactccaattaggagagatttctctgcatcttacttttctggggaacaagaggtgactccaagtcgatcaactttgcaaatagggaaaagagatgctaatagcagtttctttgacaattctagcagtcctcatcttttggatcaattaaaagcgcagaatcaagagctaagaaacaagattaatgagttggaactacgcctgcaaggacatgaaaaagaaatgaaaggccaagtgaataagtttcaagaactccaactccaactggagaaagcaaaagtggaattaattgaaaaagagaaagttttgaacaaatgtagggatgaactagtgagaacaacagcacaatacgaccaggcgtcaaccaagtatactgcattggaacaaaaactgaaaaaattgacggaagatttgagttgtcagcgacaaaatgcagaaagtgccagatgttctctggaacagaaaattaaggaaaaagaaaaggagtttcaagaggagctctcccgtcaacagcgttctttccaaacactggaccaggagtgcatccagatgaaggccagactcacccaggagttacagcaagccaagaatatgcacaacgtcctgcaggctgaactggataaactcacatcagtaaagcaacagctagaaaacaatttggaagagtttaagcaaaagttgtgcagagctgaacaggcgttccaggcgagtcagatcaaggagaatgagctgaggagaagcatggaggaaatgaagaaggaaaacaacctccttaagagtcactctgagcaaaaggccagagaagtctgccacctggaggcagaactcaagaacatcaaacagtgtttaaatcagagccagaattttgcagaagaaatgaaagcgaagaatacctctcaggaaaccatgttaagagatcttcaagaaaaaataaatcagcaagaaaactccttgactttagaaaaactgaagcttgctgtggctgatctggaaaagcagcgagattgttctcaagaccttttgaagaaaagagaacatcacattgaacaacttaatgataagttaagcaagacagagaaagagtccaaagccttgctgagtgctttagagttaaaaaagaaagaatatgaagaattgaaagaagagaaaactctgttttcttgttggaaaagtgaaaacgaaaaacttttaactcagatggaatcagaaaaggaaaacttgcagagtaaaattaatcacttggaaacttgtctgaagacacagcaaataaaaagtcatgaatacaacgagagagtaagaacgctggagatggacagagaaaacctaagtgtcgagatcagaaaccttcacaacgtgttagacagtaagtcagtggaggtagagacccagaaactagcttatatggagctacagcagaaagctgagttctcagatcagaaacatcagaaggaaatagaaaatatgtgtttgaagacttctcagcttactgggcaagttgaagatctagaacacaagcttcagttactgtcaaatgaaataatggacaaagaccggtgttaccaagacttgcatgccgaatatgagagcctcagggatctgctaaaatccaaagatgcttctctggtgacaaatgaagatcatcagagaagtcttttggcttttgatcagcagcctgccatgcatcattcctttgcaaatataattggagaacaaggaagcatgccttcagagaggagtgaatgtcgtttagaagcagaccaaagtccgaaaaattctgccatcctacaaaatagagttgattcacttgaattttcattagagtctcaaaaacagatgaactcagacctgcaaaagcagtgtgaagagttggtgcaaatcaaaggagaaatagaagaaaatctcatgaaagcagaacagatgcatcaaagttttgtggctgaaacaagtcagcgcattagtaagttacaggaagacacttctgctcaccagaatgttgttgctgaaaccttaagtgcccttgagaacaaggaaaaagagctgcaacttttaaatgataaggtagaaactgagcaggcagagattcaagaattaaaaaagagcaaccatctacttgaagactctctaaaggagctacaacttttatccgaaaccctaagcttggagaagaaagaaatgagttccatcatttctctaaataaaagggaaattgaagagctgacccaagagaatgggactcttaaggaaattaatgcatccttaaatcaagagaagatgaacttaatccagaaaagtgagagttttgcaaactatatagatgaaagggagaaaagcatttcagagttatctgatcagtacaagcaagaaaaacttattttactacaaagatgtgaagaaaccggaaatgcatatgaggatcttagtcaaaaatacaaagcagcacaggaaaagaattctaaattagaatgcttgctaaatgaatgcactagtctttgtgaaaataggaaaaatgagttggaacagctaaaggaagcatttgcaaaggaacaccaagaattcttaacaaaattagcatttgctgaagaaagaaatcagaatctgatgctagagttggagacagtgcagcaagctctgagatctgagatgacagataaccaaaacaattctaagagcgaggctggtggtttaaagcaagaaatcatgactttaaaggaagaacaaaacaaaatgcaaaaggaagttaatgacttattacaagagaatgaacagctgatgaaggtaatgaagactaaacatgaatgtcaaaatctagaatcagaaccaattaggaactctgtgaaagaaagagagagtgagagaaatcaatgtaattttaaacctcagatggatcttgaagttaaagaaatttctctagatagttataatgcgcagttggtgcaattagaagctatgctaagaaataaggaattaaaacttcaggaaagtgagaaggagaaggagtgcctgcagcatgaattacagacaattagaggagatcttgaaaccagcaatttgcaagacatgcagtcacaagaaattagtggccttaaagactgtgaaatagatgcggaagaaaagtatatttcagggcctcatgagttgtcaacaagtcaaaacgacaatgcacaccttcagtgctctctgcaaacaacaatgaacaagctgaatgagctagagaaaatatgtgaaatactgcaggctgaaaagtatgaactcgtaactgagctgaatgattcaaggtcagaatgtatcacagcaactaggaaaatggcagaagaggtagggaaactactaaatgaagttaaaatattaaatgatgacagtggtcttctccatggtgagttagtggaagacataccaggaggtgaatttggtgaacaaccaaatgaacagcaccctgtgtctttggctccattggacgagagtaattcctacgagcacttgacattgtcagacaaagaagttcaaatgcactttgccgaattgcaagagaaattcttatctttacaaagtgaacacaaaattttacatgatcagcactgtcagatgagctctaaaatgtcagagctgcagacctatgttgactcattaaaggccgaaaatttggtcttgtcaacgaatctgagaaactttcaaggtgacttggtgaaggagatgcagctgggcttggaggaggggctcgttccatccctgtcatcctcttgtgtgcctgacagctctagtcttagcagtttgggagactcctccttttacagagctcttttagaacagacaggagatatgtctcttttgagtaatttagaaggggctgtttcagcaaaccagtgcagtgtagatgaagtattttgcagcagtctgcaggaggagaatctgaccaggaaagaaaccccttcggccccagcgaagggtgttgaagagcttgagtccctctgtgaggtgtaccggcagtccctcgagaagctagaagagaaaatggaaagtcaagggattatgaaaaataaggaaattcaagagctcgagcagttattaagttctgaaaggcaagagcttgactgccttaggaagcagtatttgtcagaaaatgaacagtggcaacagaagctgacaagcgtgactctggagatggagtccaagttggcggcagaaaagaaacagacggaacaactgtcacttgagctggaagtagcacgactccagctacaaggtctggacttaagttctcggtctttgcttggcatcgacacagaagatgctattcaaggccgaaatgagagctgtgacatatcaaaagaacatacttcagaaactacagaaagaacaccaaagcatgatgttcatcagatttgtgataaagatgctcagcaggacctcaatctagacattgagaaaataactgagactggtgcagtgaaacccacaggagagtgctctggggaacagtccccagataccaattatgagcctccaggggaagataaaacccagggctcttcagaatgcatttctgaattgtcattttctggtcctaatgctttggtacctatggatttcctggggaatcaggaagatatccataatcttcaactgcgggtaaaagagacatcaaatgagaatttgagattacttcatgtgatagaggaccgtgacagaaaagttgaaagtttgctaaatgaaatgaaagaattagactcaaaactccatttacaggaggtacaactaatgaccaaaattgaagcatgcatagaattggaaaaaatagttggggaacttaagaaagaaaactcagatttaagtgaaaaattggaatatttttcttgtgatcaccaggagttactccagagagtagaaacttctgaaggcctcaattctgatttagaaatgcatgcagataaatcatcacgtgaagatattggagataatgtggccaaggtgaatgacagctggaaggagagatttcttgatgtggaaaatgagctgagtaggatcagatcggagaaagctagcattgagcatgaagccctctacctggaggctgacttagaggtagttcaaacagagaagctatgtttagaaaaagacaatgaaaataagcagaaggttattgtctgccttgaagaagaactctcagtggtcacaagtgagagaaaccagcttcgtggagaattagatactatgtcaaaaaaaaccacggcactggatcagttgtctgaaaaaatgaaggagaaaacacaagagcttgagtctcatcaaagtgagtgtctccattgcattcaggtggcagaggcagaggtgaaggaaaagacggaactccttcagactttgtcctctgatgtgagtgagctgttaaaagacaaaactcatctccaggaaaagctgcagagtttggaaaaggactcacaggcactgtctttgacaaaatgtgagctggaaaaccaaattgcacaactgaataaagagaaagaattgcttgtcaaggaatctgaaagcctgcaggccagactgagtgaatcagattatgaaaagctgaatgtctccaaggccttggaggccgcactggtggagaaaggtgagttcgcattgaggctgagctcaacacaggaggaagtgcatcagctgagaagaggcatcgagaaactgagagttcgcattgaggccgatgaaaagaagcagctgcacatcgcagagaaactgaaagaacgcgagcgggagaatgattcacttaaggataaagttgagaaccttgaaagggaattgcagatgtcagaagaaaaccaggagctagtgattcttgatgccgagaattccaaagcagaagtagagactctaaaaacacaaatagaagagatggccagaagcctgaaagtttttgaattagaccttgtcacgttaaggtctgaaaaagaaaatctgacaaaacaaatacaagaaaaacaaggtcagttgtcagaactagacaagttactctcttcatttaaaagtctgttagaagaaaaggagcaagcagagatacagatcaaagaagaatctaaaactgcagtggagatgcttcagaatcagttaaaggagctaaatgaggcagtagcagccttgtgtggtgaccaagaaattatgaaggccacagaacagagtctagacccaccaatagaggaagagcatcagctgagaaatagcattgaaaagctgagagcccgcctagaagctgatgaaaagaagcagctctgtgtcttacaacaactgaaggaaagtgagcatcatgcagatttacttaagggtagagtggagaaccttgaaagagagctagagatagccaggacaaaccaagagcatgcagctcttgaggcagagaattccaaaggagaggtagagaccctaaaagcaaaaatagaagggatgacccaaagtctgagaggtctggaattagatgttgttactataaggtcagaaaaagaaaatctgacaaatgaattacaaaaagagcaagagcgaatatctgaattagaaataataaattcatcatttgaaaatattttgcaagaaaaagagcaagagaaagtacagatgaaagaaaaatcaagcactgccatggagatgcttcaaacacaattaaaagagctcaatgagagagtggcagccctgcataatgaccaagaagcctgtaaggccaaagagcagaatcttagtagtcaagtagagtgtcttgaacttgagaaggctcagttgctacaaggccttgatgaggccaaaaataattatattgttttgcaatcttcagtgaatggcctcattcaagaagtagaagatggcaagcagaaactggagaagaaggatgaagaaatcagtagactgaaaaatcaaattcaagaccaagagcagcttgtctctaaactgtcccaggtggaaggagagcaccaactttggaaggagcaaaacttagaactgagaaatctgacagtggaattggagcagaagatccaagtgctacaatccaaaaatgcctctttgcaggacacattagaagtgctgcagagttcttacaagaatctagagaatgagcttgaattgacaaaaatggacaaaatgtcctttgttgaaaaagtaaacaaaatgactgcaaaggaaactgagctgcagagggaaatgcatgagatggcacagaaaacagcagagctgcaagaagaactcagtggagagaaaaataggctagctggagagttgcagttactgttggaagaaataaagagcagcaaagatcaattgaaggagctcacactagaaaatagtgaattgaagaagagcctagattgcatgcacaaagaccaggtggaaaaggaagggaaagtgagagaggaaatagctgaatatcagctacggcttcatgaagctgaaaagaaacaccaggctttgcttttggacacaaacaaacagtatgaagtagaaatccagacataccgagagaaattgacttctaaagaagaatgtctcagttcacagaagctggagatagaccttttaaagtctagtaaagaagagctcaataattcattgaaagctactactcagattttggaagaattgaagaaaaccaagatggacaatctaaaatatgtaaatcagttgaagaaggaaaatgaacgtgcccaggggaaaatgaagttgttgatcaaatcctgtaaacagctggaagaggaaaaggagatactgcagaaagaactctctcaacttcaagctgcacaggagaagcagaaaacaggtactgttatggataccaaggtcgatgaattaacaactgagatcaaagaactgaaagaaactcttgaagaaaaaaccaaggaggcagatgaatacttggataagtactgttccttgcttataagccatgaaaagttagagaaagctaaagagatgttagagacacaagtggcccatctgtgttcacagcaatctaaacaagattcccgagggtctcctttgctaggtccagttgttccaggaccatctccaatcccttctgttactgaaaagaggttatcatctggccaaaataaagcttcaggcaagaggcaaagatccagtggaatatgggagaatggtagaggaccaacacctgctaccccagagagcttttctaaaaaaagcaagaaagcagtcatgagtggtattcaccctgcagaagacacggaaggtactgagtttgagccagagggacttccagaagttgtaaagaaagggtttgctgacatcccgacaggaaagactagcccatatatcctgcgaagaacaaccatggcaactcggaccagcccccgcctggctgcacagaagttagcgctatccccactgagtctcggcaaagaaaatcttgcagagtcctccaaaccaacagctggtggcagcagatcacaaaaggtcaaagttgctcagcggagcccagtagattcaggcaccatcctccgagaacccaccacgaaatccgtcccagtcaataatcttcctgagagaagtccgactgacagccccagagagggcctgagggtcaagcgaggccgacttgtccccagccccaaagctggactggagtccaacggcagtgagaactgtaaggtccagtga

SEQ ID NO: 73 - protein, 910 aa, Homosapien
MDTAEEDICRVCRSEGTPEKPLYHPCVCTGSIKFIHQECLVQWLKHSRKEYCELCKHRFAFTPIYSPDMPSRLPIQDIFAGLVTSIGTAIRYWFHYTLVAFAWLGVVPLTACRIYKCLFTGSVSSLLTLPLDMLSTENLLADCLQGCFVVTCTLCAFISLVWLREQIVHGGAPIWLEHAAPPFNAAGHHQNEAPAGGNGAENVAADQPANPPAENAVVGENPDAQDDQAEEEEEDNEEEDDAGVEDAADANNGAQDDMNWNALEWDRAAEELTWERMLGLDGSLVFLEHVFWVVSLNTLFILVFAFCPYHIGHFSLVGLGFEEHVQASHFEGLITTIVGYILLAITLIICHGLATLVKFHRSRRLLGVCYIVVKVSLLVVVEIGVFPLICGWWLDICSLEMFDATLKDRELSFQSAPGTTMFLHWLVGMVYVFYFASFILLLREVLRPGVLWFLRNLNDPDFNPVQEMIHLPIYRHLRRFILSVIVFGSIVLLMLWLPIRIIKSVLPNFLPYNVMLYSDAPVSELSLELLLLQVVLPALLEQGHTRQWLKGLVRAWTVTAGYLLDLHSYLLGDQEENENSANQQVNNNQHARNNNAIPVVGEGLHAAHQAILQQGGPVGFQPYRRPLNFPLRIFLLIVFMCITLLIASLICLTLPVFAGRWLMSFWTGTAKIHELYTAACGLYVCWLTIRAVTVMVAWMPQGRRVIFQKVKEWSLMIMKTLIVAVLLAGVVPLLLGLLFELVIVAPLRVPLDQTPLFYPWQDWALGVLHAKIIAAITLMGPQWWLKTVIEQVYANGIRNIDLHYIVRKLAAPVISVLLLSLCVPYVIASGVVPLLGVTAEMQNLVHRRIYPFLLMVVVLMAILSFQVRQFKRLYEHIKNDKYLVGQRLVNYERKSGKQGSSPPPPQSSQE

SEQ ID NO: 74 - DNA, 2733 bp, Homosapien
atggacaccgcggaggaagacatatgtagagtgtgtcggtcagaaggaacacctgagaaaccgctttatcatccttgtgtatgtactggcagtattaagtttatccatcaagaatgcttagttcaatggctgaaacacagtcgaaaagaatactgtgaattatgcaagcacagatttgcttttacaccaatttattctccagatatgccttcacggcttccaattcaagacatatttgctggactggttacaagtattggcactgcaatacgatattggtttcattatacacttgtggcctttgcatggttgggagttgttcctcttacagcatgccgcatctacaagtgcttgtttactggctccgtgagctcactactgacgctgccattagatatgctgtcaacggaaaatttgttggcagattgtttgcagggttgttttgtggtgacgtgcacactgtgtgcattcatcagcctggtgtggttgagagagcagatagtccatgggggagcaccaatttggttggagcatgctgccccaccgttcaatgctgcggggcatcaccaaaatgaggctccagcaggaggaaatggtgcagaaaatgttgctgctgatcagcctgctaacccaccagctgagaacgcagtggtgggggaaaaccctgatgcccaggatgaccaggcagaagaggaggaggaggacaatgaggaggaagatgacgctggtgtggaggatgcggcagatgctaataacggagcccaggatgacatgaattggaatgctttagaatgggaccgagctgctgaagagcttacatgggaaagaatgctaggacttgatggatcactagtttttctggaacatgtcttctgggtggtatctttaaatacactgttcattcttgtttttgcattttgcccttaccatattggtcatttctcccttgttggtttgggatttgaagaacacgtccaagcatctcattttgaaggcctaatcacaaccatagttgggtatatacttttagcaataacactgataatttgtcatggcttggcaactcttgtgaaatttcatagatctcgtcgcttactgggagtctgctatattgttgttaaggtctctttgttagtggtggtagaaattggagtattccctctcatttgtggttggtggctggatatctgttccttggaaatgtttgatgctactctgaaagatcgagaactgagctttcagtcggctccaggtactaccatgtttctgcattggctagtgggaatggtatatgtcttctactttgcctccttcattctactactgagagaggtacttcgacctggtgtcctgtggtttctaaggaatttgaatgatccagatttcaatccagtacaggaaatgatccatttgccaatatataggcatctccgaagatttattttgtcagtgattgtctttggctccattgtcctcctgatgctttggcttcctatacgtataattaagagtgtgctgcctaattttcttccatacaatgtcatgctctacagtgatgctccagtgagtgaactgtccctcgagctgcttctgcttcaggttgtcttgccagcattactcgaacagggacacacgaggcagtggctgaaggggctggtgcgagcgtggactgtgaccgccggatacttgctggatcttcattcttatttattgggagaccaggaagaaaatgaaaacagtgcaaatcaacaagttaacaataatcagcatgctcgaaataacaacgctattcctgtggtgggagaaggccttcatgcagcccaccaagccatactccagcagggagggcctgttggctttcagccttaccgccgacctttaaattttccactcaggatatttctgttgattgtcttcatgtgtataacattactgattgccagcctcatctgccttactttaccagtatttgctggccgttggttaatgtcgttttggacggggactgccaaaatccatgagctctacacagctgcttgtggtctctatgtttgctggctaaccataagggctgtgacggtgatggtggcatggatgcctcagggacgcagagtgatcttccagaaggttaaagagtggtctctcatgatcatgaagactttgatagttgcggtgctgttggctggagttgtccctctccttctggggctcctgtttgagctggtcattgtggctcccctgagggttcccttggatcagactcctcttttttatccatggcaggactgggcacttggagtcctgcatgccaaaatcattgcagctataacattgatgggtcctcagtggtggttgaaaactgtaattgaacaggtttacgcaaatggcatccggaacattgaccttcactatattgttcgtaaactggcagctcccgtgatctctgtgctgttgctttccctgtgtgtaccttatgtcatagcttctggtgttgttcctttactaggtgttactgcggaaatgcaaaacttagtccatcggcggatttatccatttttactgatggtcgtggtattgatggcaattttgtccttccaagtccgccagtttaagcgcctttatgaacatattaaaaatgacaagtaccttgtgggtcaacgactcgtgaactacgaacggaaatctggcaaacaaggctcatctccaccacctccacagtcatcccaagaataa

SEQ ID NO: 75 - protein, 955 aa, Homosapien
MEVGSEEEKWEKLDAEFDHFVVDMKPFVLKLPHRTERQRCALWIRKLCEPSGTGAGIMGRKNRNLYAKLLLHMLKRGALEGPFTHRPEPGTLKILPSYMSIYFDEPNPARAKGSSPEGLPAWVLGELETSEHKLNESWKLSSGEDNTLVQSPTDVYSREQYTGKLRVRSHSLSPTHREDGQNITPKICEVYSKKSPVSLDDSDIEARLNSWNLGIENPRYLRQKPIPVSLMTPKFSLRKSSSFHDDHFLSRIREKELDMKTKMMEAKFHEEKLKLQQKHDADVQKILERKNNEIEELKTLYRSKQHETEETIRKLEKKVQTLIRDCQVIRETKEDQIAELKKICEQSTESLNNDWEKKLHNAVAEMEQEKFDLQKQHTENIQELLEDTNVRLNKMESEYMAQTQSTNHMIKELEARVQQLTGEAENSNLQRQKLIQEKAELERCYQITCSELQEVKARRNTLHKEKDHLVNDYEQNMKLLQTKYDADINLLKQEHALSASKASSMIEELEQNVCQLKQQLQESELQRKQQLRDQENKFQMEKSHLKHIYEKKAHDLQSELDKGKEDTQKKIHKFEEALKEKEEQLTRVTEVQRLQAQQADAALEEFKRQVELNSEKVYAEMKEQMEKVEADLTRSKSLREKQSKEFLWQLEDIRQRYEQQIVELKLEHEQEKTHLLQQHNAEKDSLVRDHEREIENLEKQLRAANMEHENQIQEFKKRDAQVIADMEAQVHKLREELINVNSQRKQQLVELGLLREEEKQRATREHEIVVNKLKAESEKMKIELKKTHAAETEMTLEKANSKLKQIEKEYTQKLAKSSQIIAELQTTISSLKEENSQQQLAAERRLQDVRQKFEDEKKQLIRDNDQAIKVLQDELENRSNQVRCAEKKLQHKELESQEQITYIRQEYETKLKGLMPASLRQELEDTISSLKSQVNFLQKRASILQEELTTYQGRR

SEQ ID NO: 76 - DNA, 2868 bp, Homosapien
atggaagtgggaagtgaagaagaaaaatgggagaagctggatgcagaatttgatcactttgtggttgatatgaagccctttgttctaaaattacctcataggacagaacggcagaggtgtgctctttggattagaaagctgtgcgaaccttcaggaacaggtgcaggaataatggggaggaagaatcggaacctgtatgcaaaattgttattgcatatgcttaaacgaggtgcgcttgaaggcccttttacacaccgacctgaacccgggacactaaaaattctaccttcatacatgtccatctattttgatgaaccaaatccagcacgagcaaaaggttcaagcccagagggattaccagcctgggtactgggtgagctggagacaagtgaacacaaattaaatgaatcatggaaactctcttctggagaagataacactttagtacagtcgccaactgatgtctacagcagggaacagtacactgggaagctccgagtgagatcacactccttgagtccaactcacagagaagatggacaaaatattaccccaaagatttgtgaagtttattcgaaaaaatctcctgtttctttggatgatagtgacattgaagctcgccttaatagttggaatcttgggatagaaaatcctcgatacctgagacagaagcctatcccagtttctctgatgacaccgaaattcagcctgagaaaatccagcagtttccatgatgatcattttctctctcgaatacgtgagaaagagctggacatgaaaacaaaaatgatggaagctaaatttcatgaagaaaagcttaaactgcaacagaaacatgatgctgatgttcagaagattttagaaagaaagaataatgaaatagaagaactgaaaactttatacaggagtaaacaacatgaaactgaagagactattagaaagcttgaaaagaaagttcagacactgatacgtgactgtcaagttatcagagagactaaagaagaccagattgcagagctgaaaaagatatgtgaacaaagtacggaatctctaaataatgactgggaaaaaaagcttcacaatgctgtagcagaaatggaacaggaaaagtttgatcttcaaaagcaacacactgaaaacattcaagaattgcttgaggatacaaatgtgcgtctgaataaaatggagagtgaatacatggcgcaaacacagtccacaaaccacatgatcaaagaactggaggcccgtgtccagcagctgactggagaagcagagaacagtaatttacagaggcagaaattaattcaagaaaaagcagaacttgaaagatgttaccagataacgtgtagtgaattacaagaagtaaaggcaaggcgtaacacactgcataaagagaaggaccatcttgtaaatgattatgagcaaaacatgaaactgttacaaaccaaatatgatgctgatataaaccttctaaaacaagaacatgctctttcagcttctaaggcatctagtatgattgaagaattagagcagaatgtctgtcaattaaaacagcagttacaggaatcagaacttcaaagaaagcaacaactaagggatcaagaaaataagtttcagatggagaaaagtcatttaaaacacatctatgaaaaaaaggctcatgacttgcagagtgaacttgataaaggaaaagaagatactcaaaagaaaattcataaatttgaggaagctttgaaggaaaaagaggagcagctaactcgtgtgactgaagttcagaggttgcaggcccagcaggcagatgccgctctggaagagtttaagcggcaggtggaactgaactcagagaaagtctatgctgaaatgaaagagcagatggaaaaagtggaggcagatctaactagatccaaatctcttcgtgagaaacaatcaaaggagtttttatggcaactggaggacatcagacagcggtatgaacaacagatagtagagctgaagctggagcatgaacaggagaagacgcacctattacagcagcataacgcagagaaggatagcctagtccgagaccatgaacgggaaattgaaaacctggaaaaacagcttcgcgctgccaatatggagcacgaaaatcaaattcaggagttcaagaaacgagatgcacaggttattgccgacatggaggcccaggttcacaagttgagagaagaattgatcaatgtgaactcacagcggaaacagcagctggtagagcttggtcttcttcgtgaagaggaaaagcaaagggctacaagggaacatgagattgtcgtcaataaactgaaggctgaatcagaaaagatgaaaatagagctgaaaaagactcatgctgctgagacagagatgacactggaaaaggccaacagcaagctgaagcagattgagaaggaatacactcagaagcttgccaaatcttcacagatcatagcagaacttcagacaaccatttcctctctgaaagaagagaacagccagcagcagcttgctgcagaaaggcggctccaggatgttagacaaaagtttgaagatgagaagaagcagctgattagagataatgaccaagcaatcaaggttttacaagatgaattagaaaaccgttctaatcaggtgcgatgtgcagagaaaaaattacaacacaaagaattggagtcacaggaacagataacttacatacgacaagaatatgaaacaaaattgaaaggattgatgccagcatccctaagacaagaacttgaagacaccatttcctccctaaaatcacaggttaattttctgcaaaagagagcttccatccttcaggaagaactgactacatatcaaggcagaaggtaa

SEQ ID NO: 77 - protein, 1392 aa, Homosapien
MSMLKPSGLKAPTKILKPGSTALKTPTAVVAPVEKTISSEKASSTPSSETQEEFVDDFRVGERVWVNGNKPGFIQFLGETQFAPGQWAGIVLDEPIGKNDGSVAGVRYFQCEPLKGIFTRPSKLTRKVQAEDEANGLQTTPASRATSPLCTSTASMVSSSPSTPSNIPQKPSQPAAKEPSATPPISNLTKTASESISNLSEAGSIKKGERELKIGDRVLVGGTKAGVVRFLGETDFAKGEWCGVELDEPLGKNDGAVAGTRYFQCQPKYGLFAPVHKVTKIGFPSTTPAKAKANAVRRVMATTSASLKRSPSASSLSSMSSVASSVSSRPSRTGLLTETSSRYARKISGTTALQEALKEKQQHIEQLLAERDLERAEVAKATSHVGEIEQELALARDGHDQHVLELEAKMDQLRTMVEAADREKVELLNQLEEEKRKVEDLQFRVEEESITKGDLEVATVSEKSRIMELEKDLALRVQEVAELRRRLESNKPAGDVDMSLSLLQEISSLQEKLEVTRTDHQREITSLKEHFGAREETHQKEIKALYTATEKLSKENESLKSKLEHANKENSDVIALWKSKLETAIASHQQAMEELKVSFSKGLGTETAEFAELKTQIEKMRLDYQHEIENLQNQQDSERAAHAKEMEALRAKLMKVIKEKENSLEAIRSKLDKAEDQHLVEMEDTLNKLQEAEIKVKELEVLQAKCNEQTKVIDNFTSQLKATEEKLLDLDALRKASSEGKSEMKKLRQQLEAAEKQIKHLEIEKNAESSKASSITRELQGRELKLTNLQENLSEVSQVKETLEKELQILKEKFAEASEEAVSVQRSMQETVNKLHQKEEQFNMLSSDLEKLRENLADMEAKFREKDEREEQLIKAKEKLENDIAEIMKMSGDNSSQLTKMNDELRLKERDVEELQLKLTKANENASFLQKSIEDMTVKAEQSQQEAAKKHEEEKKELERKLSDLEKKMETSHNQCQELKARYERATSETKTKHEEILQNLQKTLLDTEDKLKGAREENSGLLQELEELRKQADKAKAAQTAEDAMQIMEQMTKEKTETLASLEDTKQTNAKLQNELDTLKENNLKNVEELNKSKELLTVENQKMEEFRKEIETLKQAAAQKSQQLSALQEENVKLAEELGRSRDEVTSHQKLEEERSVLNNQLLEMKKRESKFIKDADEEKASLQKSISITSALLTEKDAELEKLRNEVTVLRGENASAKSLHSVVQTLESDKVKLELKVKNLELQLKENKRQLSSSSGNTDTQADEDERAQESQIDFLNSVIVDLQRKNQDLKMKVEMMSEAALNGNGDDLNNYDSDDQEKQSKKKPRLFCDICDCFDLHDTEDCPTQAQMSEDPPHSTHHGSRGEERPYCEICEMFGHWATNCNDDETF

SEQ ID NO: 78 - DNA, 4179 bp, Homosapien
atgagtatgctaaagccaagtgggcttaaggcccccaccaagatcctgaagcctggaagcacagctctgaagacacctacggctgttgtagctccagtagaaaaaaccatatccagtgaaaaagcatcaagcactccatcatctgagactcaggaggaatttgtggatgactttcgagttggggagcgagtttgggtgaatggaaataagcctggatttatccagtttcttggagaaacccagtttgcaccaggccagtgggctggaattgttttagatgaacccataggcaagaacgatggttcggtggcaggagttcggtatttccagtgtgaacctttaaagggcatatttacccgaccttcaaagttaacaaggaaggtgcaagcagaagatgaagctaatggcctgcagacaacgcccgcctcccgagctacttcaccgctgtgcacttctacggccagcatggtgtcttcctccccctccaccccttcaaacatccctcagaaaccatcacagccagcagcaaaggaaccttcagctacgcctccgatcagcaaccttacaaaaactgccagtgaatctatctccaacctttcagaggctggctcaatcaagaaaggagaaagagagctcaaaatcggagacagagtattggttggtggcactaaggctggtgtagtccggtttcttggggagaccgactttgccaagggggagtggtgtggcgtggagttagatgagccacttgggaagaatgatggcgctgttgctggaacaaggtattttcagtgtcaacccaaatatggcttgttcgctcctgtccacaaagttaccaagattggcttcccttccactacaccagccaaagccaaggccaacgcagtgaggcgagtgatggcgaccacgtccgccagcctgaagcgcagcccttctgcctcttccctcagctccatgagctcagtggcctcctctgtgagcagcaggcccagtcggacaggactattgactgaaacctcctcccgttacgccaggaagatctccggtaccactgccctccaggaggccctgaaggagaagcagcagcacattgagcagctgctggcggaacgggatctggagagggcggaggtggccaaggccacgagccacgtgggggagatagagcaggagctagctctggcccgggacggacatgaccagcatgtcctggaattggaagccaaaatggaccagctgcgaacaatggtggaagctgctgacagggagaaggtggagcttctcaaccagcttgaagaggagaaaaggaaggttgaggaccttcagttccgggttgaagaagaatcaattaccaaaggtgatcttgaggtggctacagtttcagaaaagtcacgtataatggaactggagaaagacctagcattgagagtacaggaagtagctgagctccgaagaaggctagagtccaataagcctgctggggatgtggacatgtcactttcccttttgcaagagataagctctttgcaagaaaagttagaagtcacccgtactgaccaccagagagaaataacttctctgaaggagcattttggagcccgggaagaaactcatcagaaggagataaaggctctgtataccgccacggaaaagctttccaaagagaacgagtcattgaaaagcaagctggagcatgccaacaaagagaactcagatgtgatagctctatggaagtccaaactggagactgccatcgcatcccaccagcaggcgatggaagaactgaaggtatctttcagcaaagggcttggaacagagacggcagaatttgctgaactaaaaacacaaatagagaaaatgagactagattaccaacacgaaatagaaaatttgcagaatcaacaagactctgaacgggctgcccatgctaaagagatggaagccttgagggctaaactgatgaaagttattaaagaaaaggaaaacagtctggaagccatcaggtcgaaactggacaaagcagaagaccagcatctcgtagaaatggaagacacgttaaacaaattacaggaagctgaaataaaggtaaaggagctagaggtactgcaagccaaatgcaatgaacaaaccaaggttattgataattttacatcacagctcaaggctactgaagaaaagctcttggatcttgatgcacttcggaaagccagttccgaaggtaaatcggaaatgaagaaacttagacagcagcttgaggcagctgagaaacagattaaacatttagagattgaaaagaatgctgaaagtagcaaggctagtagcattaccagagagctccaggggagagagctaaagcttactaaccttcaggaaaatttgagtgaagtcagtcaagtgaaagagactttggaaaaagaacttcagattttgaaagaaaagtttgctgaagcttcagaggaggcagtctctgttcagagaagtatgcaagaaactgtaaataagttacaccaaaaggaggaacagtttaacatgctgtcttctgacttggagaagctgagagaaaacttagcagatatggaggcaaaatttagagagaaagatgagagagaagagcagctgataaaggcaaaggaaaaactggaaaatgacattgcagaaataatgaagatgtcaggagataactcttctcagctgacaaaaatgaacgatgaattacgtctgaaagaaagagatgtagaagaattacagctaaaacttacaaaggctaatgaaaatgcaagttttctgcaaaaaagtattgaggacatgactgtcaaagctgaacagagccagcaagaagcagctaaaaagcatgaggaagaaaagaaagaattggagaggaaattgtcggacctggaaaagaaaatggaaacaagccacaaccagtgtcaggagctgaaagccaggtatgagagagccacttctgagacaaaaaccaagcatgaagaaatcctacagaacctccagaagacgctgctggacacagaggacaagctgaagggcgcacgggaggagaacagtggcttgctgcaggagctggaggagctgagaaagcaagccgacaaagccaaagctgctcaaacagcggaagatgccatgcagataatggaacagatgaccaaagagaagactgagactctggcctccttggaggacaccaagcaaacaaatgcaaaactacagaatgaattggacacacttaaagaaaacaacttgaaaaatgtggaagagctgaacaaatcaaaagaactcctgactgtagagaatcaaaaaatggaagaatttaggaaagaaatagaaaccctaaagcaggcagcagctcagaagtcccagcagctttcagcgttgcaagaagagaacgttaaacttgctgaggagctggggagaagcagggacgaagtcacaagtcatcaaaagctggaagaagaaagatctgtgctcaataatcagttgttagaaatgaaaaaaagagaatccaagttcataaaagacgcagatgaagagaaagcttccttgcagaaatccatcagtataactagtgccttactcacagaaaaggatgccgagctggagaaactgagaaatgaggtcacagtgctcaggggagaaaacgcctctgccaagtccttgcattcagttgttcagactctagagtctgataaggtgaagctcgagctcaaggtaaagaacttggagcttcaactcaaagaaaacaagaggcagctcagcagctcctcaggtaatacagacactcaggcagacgaggatgaaagagcccaggagagtcagattgatttcctaaattcagtaatagtggaccttcaaaggaagaatcaagacctcaagatgaaggtggagatgatgtcagaagcagccctgaatgggaacggggatgacctaaacaattatgacagtgatgatcaggagaaacagtccaagaagaaacctcgcctcttctgtgacatttgtgactgctttgatctccacgacacagaggattgtcctacccaggcacagatgtcagaggaccctccccattccacacaccatggcagtcggggtgaggaacgcccatactgtgaaatctgtgagatgtttggacactgggccaccaactgcaatgacgacgaaaccttctga

SEQ ID NO: 79 - protein, 1417 aa, Homosapien
MASPTNGHHGGNCGKCSPGRAPLVGSGALADHDPRQAPRLRRRLTQSAPGRGSDRVGASQRLPRRFEFCAAGVRWFSELCPRLPRAGARERVRGFLTQTRVRSAQSPGGSLPSDDLGEMESSSSDYYNKDNEEESLLANVASLRHELKITEWSLQSLGEELSSVSPSENSDYAPNPSRSEKLILDVQPSHPGLLNYSPYENVCKISGSSTDFQKKPRDKMFSSSAPVDQEIKSLREKLNKLRQQNACLVTQNHSLMTKFESIHFELTQSRAKVSMLESAQQQAASVPILEEQIINLEAEVSAQDKVLREAENKLEQSQKMVIEKEQSLQESKEECIKLKVDLLEQTKQGKRAERQRNEALYNAEELSKAFQQYKKKVAEKLEKVQAEEEILERNLTNCEKENKRLQERCGLYKSELEILKEKLRQLKEENNNGKEKLRIMAVKNSEVMAQLTESRQSILKLESELENKDEILRDKFSLMNENRELKVRVAAQNERLDLCQQEIESSRVELRSLEKIISQLPLKRELFGFKSYLSKYQMSSFSNKEDRCIGCCEANKLVISELRIKLAIKEAEIQKLHANLTANQLSQSLITCNDSQESSKLSSLETEPVKLGGHQVAESVKDQNQHTMNKQYEKERQRLVTGIEELRTKLIQIEAENSDLKVNMAHRTSQFQLIQEELLEKASNSSKLESEMTKKCSQLLTLEKQLEEKIVAYSSIAAKNAELEQELMEKNEKIRSLETNINTEHEKICLAFEKAKKIHLEQHKEMEKQIERLEAQLEKKDQQFKEQEKTMSMLQQDIICKQHHLESLDRLLTESKGEMKKENMKKDEALKALQNQVSEETIKVRQLDSALEICKEELVLHLNQLEGNKEKFEKQLKKKSEEVYCLQKELKIKNHSLQETSEQNVILQHTLQQQQQMLQQETIRNGELEDTQTKLEKQVSKLEQELQKQRESSAEKLRKMEEKCESAAHEADLKRQKVIELTGTARQVKIEMDQYKEELSKMEKEIMHLKRDGENKAMHLSQLDMILDQTKTELEKKTNAVKELEKLQHSTETELTEALQKREVLETELQNAHGELKSTLRQLQELRDVLQKAQLSLEEKYTTIKDLTAELRECKMEIEDKKQELLEMDQALKERNWELKQRAAQVTHLDMTIREHRGEMEQKIIKLEGTLEKSELELKECNKQIESLNDKLQNAKEQLREKEFIMLQNEQEISQLKKEIERTQQRMKEMESVMKEQEQYIATQYKEAIDLGQELRLTREQVQNSHTELAEARHQQVQAQREIERLSSELEDMKQLSKEKDAHGNHLAEELGASKVREAHLEARMQAEIKKLSAEVESLKEAYHMEMISHQENHAKWKISADSQKSSVQQLNEQLEKAKLELEEAQDTVSNLHQQVQDRNEVIEAANEALLTKGENV

SEQ ID NO: 80 - DNA, 4254 bp, Homosapien
atggcttcccccaccaatgggcatcatggcggtaattgtgggaaatgtagtcccgggcgggctccgctagtgggctcgggcgcgctcgccgaccacgatccccggcaagccccgcgccttcggcggcgcctcacgcagtctgcgccggggcggggcagtgaccgggtaggcgcgtcccaacggctcccgcggcggttcgaattctgtgctgccggggttcgctggttctccgagttgtgtccgaggcttccacgcgcaggggcccgggaaagggtcagaggcttcctaacgcagactcgagtgcgaagcgcgcagtcgccgggtgggtctctccccagcgacgatttgggtgaaatggaatctagttcatcagactactataataaagacaatgaagaggaaagtttgcttgcaaatgttgcttccttaagacatgaactgaagataacagaatggagtttgcagagtttaggggaagagttatccagtgttagtccaagtgaaaattctgattatgcccctaatccttcaaggtctgaaaagctaattttggatgttcagcctagccaccctggacttttgaattattcaccttatgaaaacgtctgtaaaatatctggtagcagcactgattttcaaaaaaagccaagagataagatgttttcatcttctgcccctgtggatcaggagattaaaagccttcgagagaaactaaataaacttaggcaacagaatgcttgtttggtcacacagaatcattccttaatgactaaatttgaatctattcactttgaattaacacagtcaagagcaaaagtttctatgcttgagtctgctcaacagcaggcagccagtgtcccaatcttagaagaacagattataaatttggaagcagaggtttcagctcaagataaagttttgagagaggcagaaaataagctggaacagagccagaaaatggtaattgaaaaggaacagagtttgcaggagtccaaagaggaatgtataaaattaaaggtggacttacttgaacaaaccaaacaaggaaaaagagctgaacgacaaaggaatgaagcactatataatgccgaagagctgagtaaagctttccaacaatataaaaaaaaagtggctgaaaaactggaaaaggttcaagctgaagaagaaatattagagagaaatctaactaactgtgaaaaagaaaataaaaggctacaagaaaggtgtggtctatataaaagtgaacttgaaattctgaaagagaaattaaggcagttaaaagaagaaaataacaacggaaaagaaaaattaaggatcatggcagtgaaaaattcagaagtcatggcacaactaactgaatctagacaaagtattttgaagctagagagtgagttagagaacaaagacgaaatacttagagacaaattttctttaatgaatgaaaaccgagaattaaaggtccgtgttgcagcacagaatgagcgactagatttatgtcaacaagaaattgaaagttcaagggtagaactaagaagtttggaaaagattatatcccagttgccattaaaaagagaattatttggctttaaatcatatctttctaaataccagatgagtagcttctcaaacaaggaagaccgttgcattggctgctgtgaggcaaataaattggtgatttcggaattgagaattaagcttgcaataaaagaggcagaaattcaaaagcttcatgcaaacctgactgcaaatcagttatctcagagtcttattacttgtaatgacagccaagaaagtagcaaattaagtagtttagaaacagaacctgtaaagctaggtggtcatcaagtagcagaaagcgtaaaagatcaaaatcaacatactatgaacaagcaatatgaaaaagagaggcaaagacttgttactggaatagaagaactacgtactaagctgatacaaatagaagctgaaaattctgatttgaaggttaacatggctcacagaactagtcagtttcagctgattcaagaggagctgctagagaaagcttcaaactccagcaaactggaaagtgaaatgacaaagaaatgttctcaacttttaactcttgagaaacagctggaagaaaagatagttgcttattcctctattgctgcaaaaaatgcagaactagaacaggagcttatggaaaagaatgaaaagataaggagtctagaaaccaatattaatacagagcatgagaaaatttgtttagcctttgaaaaagcaaagaaaattcacttggaacagcataaagaaatggaaaagcagattgaaagacttgaagctcaactagagaaaaaggaccaacaatttaaagaacaagaaaagactatgtccatgttgcaacaagatataatatgcaaacaacatcatcttgaatcactagatagactcttgacggaaagcaaaggggaaatgaaaaaggaaaatatgaagaaagatgaagctttaaaagcattacagaaccaagtatctgaagaaacaatcaaggttaggcaactagattcagcattggaaatttgtaaggaagaacttgtcttgcatttgaatcaattggaaggaaataaggaaaagtttgaaaaacagttaaagaagaaatctgaagaggtatattgtttacagaaagagctaaagataaaaaatcacagtcttcaagagacttctgagcaaaacgttattctacagcatactcttcagcaacagcagcaaatgttacaacaagagacaattagaaatggagagctagaagatactcaaactaaacttgaaaaacaggtgtcaaaactggaacaagaacttcaaaaacaaagggaaagttcagctgaaaagttgagaaaaatggaggagaaatgtgaatcagctgcacatgaagcagatttgaaaaggcaaaaagtgattgagcttactggcactgccaggcaagtaaagattgagatggatcagtacaaagaagagctgtctaaaatggaaaaggaaataatgcacctaaaacgagatggagaaaataaagcaatgcacctctctcaattagatatgatcttagatcagacaaagacagagctagaaaagaaaacaaatgctgtaaaggagttagaaaagttacagcacagtactgaaactgaactaacagaagccttgcaaaaacgggaagtacttgagactgaactacaaaatgctcatggagaattaaaaagtactttaagacaactccaggaattgagagatgtactacagaaggctcaattatcattagaggaaaaatacactactataaaggatctcacagctgaacttagagaatgcaagatggagattgaagacaaaaagcaggagctccttgaaatggatcaggcacttaaagagagaaattgggaactaaagcaaagagcagctcaggttacacatttggatatgactattcgtgagcacagaggagaaatggaacaaaaaataattaaattagaaggtactctggagaaatcagaattggaacttaaagaatgtaacaaacagatagaaagtctgaatgacaaattacaaaatgctaaagaacagcttcgagaaaaagagtttataatgctacaaaatgaacaggagataagtcaactgaaaaaagaaattgaaagaacacaacaaaggatgaaagaaatggagagtgttatgaaagagcaagaacagtacattgccactcagtacaaggaggccatagatttggggcaagaattgaggctgacccgggagcaggtgcagaactctcatacagaattggcagaggctcgtcatcagcaagtccaagcacagagagaaatagaaaggctctctagtgaactggaggatatgaagcaactctctaaagagaaagatgctcatggaaaccatttagctgaagaactgggggcttctaaagtacgtgaagctcatttagaagcaagaatgcaagcagaaatcaagaaattgtcagcagaagtagaatctctcaaagaagcttatcatatggagatgatttcacatcaagagaaccatgcaaagtggaagatttctgctgactctcaaaagtcttctgttcagcaactaaacgaacagttagagaaggcaaaattggaattagaagaagctcaggatactgtaagcaatttgcatcaacaagtccaagataggaatgaagtaattgaagctgcaaatgaagcattacttactaaaggagaaaatgtgtaa

SEQ ID NO: 81 - protein, 424 aa, Homosapien
MQRLQVVLGHLRGPADSGWMPQAAPCLSGAPQASAADVVVVHGRRTAICRAGRGGFKDTTPDELLSAVMTAVLKDVNLRPEQLGDICVGNVLQPGAGAIMARIAQFLSDIPETVPLSTVNRQCSSGLQAVASIAGGIRNGSYDIGMACGVESMSLADRGNPGNITSRLMEKEKARDCLIPMGITSENVAERFGISREKQDTFALASQQKAARAQSKGCFQAEIVPVTTTVHDDKGTKRSITVTQDEGIRPSTTMEGLAKLKPAFKKDGSTTAGNSSQVSDGAAAILLARRSKAEELGLPILGVLRSYAVVGVPPDIMGIGPAYAIPVALQKAGLTVSDVDIFEINEAFASQAAYCVEKLRLPPEKVNPLGGAVALGHPLGCTGARQVITLLNELKRRGKRAYGVVSMCIGTGMGAAAVFEYPGN

SEQ ID NO: 82 - DNA, 1275 bp, Homosapien
atgcagaggctgcaggtagtgctgggccacctgaggggtccggccgattccggctggatgccgcaggccgcgccttgcctgagcggtgccccgcaggcctcggccgcggacgtggtggtggtgcacgggcggcgcacggccatctgccgggcgggccgcggcggcttcaaggacaccacccccgacgagcttctctcggcagtcatgaccgcggttctcaaggacgtgaatctgaggccggaacagctgggggacatctgtgtcggaaatgtgctgcagcctggggccggggcaatcatggcccgaatcgcccagtttctgagtgacatcccggagactgtgcctttgtccactgtcaatagacagtgttcgtcggggctacaggcagtggccagcatagcaggtggcatcagaaatgggtcttatgacattggcatggcctgtggggtggagtccatgtccctggctgacagagggaaccctggaaatattacttcgcgcttgatggagaaggagaaggccagagattgcctgattcctatggggataacctctgagaatgtggctgagcggtttggcatttcacgggagaagcaggatacctttgccctggcttcccagcagaaggcagcaagagcccagagcaagggctgtttccaagctgagattgtgcctgtgaccaccacggtccatgatgacaagggcaccaagaggagcatcactgtgacccaggatgagggtatccgccccagcaccaccatggagggcctggccaaactgaagcctgccttcaagaaagatggttctaccacagctggaaactctagccaggtgagtgatggggcagctgccatcctgctggcccggaggtccaaggcagaagagttgggccttcccatccttggggtcctgaggtcttatgcagtggttggggtcccacctgacatcatgggcattggacctgcctatgccatcccagtagctttgcaaaaagcagggctgacagtgagtgacgtggacatcttcgagatcaatgaggcctttgcaagccaggctgcctactgtgtggagaagctacgactcccccctgagaaggtgaaccccctggggggtgcagtggccttagggcacccactgggctgcactggggcacgacaggtcatcacgctgctcaatgagctgaagcgccgtgggaagagggcatacggagtggtgtccatgtgcatcgggactggaatgggagccgctgccgtctttgaataccctgggaactga

SEQ ID NO: 83 - protein, 234 aa, Homosapien
MSETSFNLISEKCDILSILRDHPENRIYRRKIEELSKRFTAIRKTKGDGNCFYRALGYSYLESLLGKSREIFKFKERVLQTPNDLLAAGFEEHKFRNFFNAFYSVVELVEKDGSVSSLLKVFNDQSASDHIVQFLRLLTSAFIRNRADFFRHFIDEEMDIKDFCTHEVEPMATECDHIQITALSQALSIALQVEYVDEMDTALNHHVFPEAATPSVYLLYKTSHYNILYAADKH

SEQ ID NO: 84 - DNA, 3873 bp, Homosapien
ctttggtttgcggagcggtcgggtgtattctccgccgcccccacgccctcgaggtccccgccaccgaaccagcggcggagcccgcccgcgcctcccgcggcattcccgcaccggatcgctcctcgctggggcgggacctggcctggcggctctggtcactatgagtgaaacatctttcaacctaatatcagaaaaatgtgacattctatccattcttcgggaccatcctgaaaacaggatttaccggaggaaaatcgaggaactcagcaaaaggttcaccgccatccgcaagaccaaaggggatgggaactgcttctacagggccttgggctattcctacctggagtccctgctggggaagagcagggagatcttcaagttcaaagaacgcgtactgcagaccccaaatgaccttctggctgctggctttgaggagcacaagttcagaaacttcttcaatgctttttacagtgtggtggaactggtagagaaggatggctcagtgtccagcctgctgaaggtgttcaacgaccagagtgcctcggaccacatcgtgcagttcctgcgcctgctcacgtcggccttcatcaggaaccgagcagacttcttccggcacttcattgatgaggagatggacatcaaagacttctgcactcacgaagtagagcccatggccacggagtgtgaccacatccagatcacggcgttgtcgcaggccctgagcattgccctgcaagtggagtacgtggacgagatggataccgccctgaaccaccacgtgttccctgaggccgccaccccttccgtttacctgctctataaaacatcccactacaacatcctttatgcagccgataaacattgattaattttaggccatgcagtggaacctgtcacctaatgggactgcattctgaatggaacattccggctcttcaattttttaagcaatttagactgtagcaagaaaatgtgcagccttttgggcaaagcccctgggaacgaggcctatccactatggactatggtaacttggtaggatttttagtatttattttaatggagggacaaatgctttctaactgggcccccgactccgcaccccagttcgcagtgaggccctgggtgggtcacctgccctctctggacttgtttcttcaactggaggaggtccctgcctatgctgacattccattgtagaaaaatggggcctctggtgtctctttaccaggggcagtgcctctctgcgggggaggaaaagctcaaggttagctgtcttaacccaagtgacttaccaggcctacaaaagagtccagtccagtcacttgttggactgggctctgacagatggcctattgaggtcaacttgaatgtgagggctacggtgtggtttcaaacattcatgatggatgtattttcctacccctaacttaaggagaaaaaaaaaaagacttcctttttttgccaaagtccagaaaggggcctttagcctttagtaggagctcaaattgttggggcccctctacctctctcagggctagaactgcctgactcttggtggacgagcccttcagggttctgctttcagccccacctggacagaggcttacaagactagggtctggaccagaatctgtgtatttctgtctgggaccaggaagccgcagctgtcccatcatccccagcaaatcctagaagtggagtctggatacttcaaggatagaagtgttggcacgcacagccatggacccagctgagcagagcagacgctttgcaggctgcccctggcttcttcctccctttcccgcttctgctctctttatggactggtcagagggtaggtgggaaagaacagacaagccatgggaagttggcagtggggagatttccactgtggaaaccgcctgggaattccggccagcagcttcctccttcagccacctggccataccccttaaataagcccctcaccttgctgcctcaggaccttcaagattccatctgtgggctggccggcaagatggcaccagtggggacccacaccctggctgggcagaggtgctgctagcaacctctcttcctctataagaggaaatggaaaatgcagggtgtggaattgccctttggggtccttccttaattgaaggccaccttctcacaggtttcattctgcagggatttactggaatctattggtgctgctgcatgagtctgctgacaacctgactgcacaaggactgggtagcagactcctcagagtcctcttgacacaaatgtcagatttgtgtcactcttctgccttcgtgaaaagccaatagcactctcagatatcaggggattttagttccaagcagggaccctggtttccatactgccctcagctggagtttggatccaaaggctctggctaagtcattatgtcactttttcacaggaatgtaaatttgactgtcacctctgaatttgttcagtgtcccaccatggtctatgagaagtacactggaagcgtggggggaacacatgacatgatttgtgaatatcatcatctttgccagacaagtctccaggggatccctgtttcccaactgaaaggtgtgaacggacacacacacagcctggatgacgccttggctgttctaaggggctgtaaggtgggctctgggccttccagctaggctctcaagcacagcagaagcctcactgggctgctatgtctctgtatttgtggcttgtgtggtagcctcagaagcagagctgtttggcagactggctggagaaattccctctaggagacttgcctgtgctgtgcttccaggtcacagagccccccggaaactcacaggggccctcttcccagaaaagaatctattctatcacttcagaatcaggacactcaagctctggcagaggaaggccaagttactttcatggtcttaccctctgcttttcccctttttgcaaaaaaccactggccaaatccgaaccattgcccttgtttcccccacgttctctctcagatctttgtctcgaagggaaaacatagtggatgaaaaggtgtggcaggctttggcaccttgttaaaatttctagtcatctgtggatgttaccttgcttgtccacagcagccagtcaccctggccagtcccacttcctggataattctctaccctcaccccacagagccatctctctccagaccaaaagctggaaggagagttgctttgagagcttgtttttacaactgcatgtttattatgatactttctctccaaaggaaacttttaaatcaatgggaacaattagcaacagaaagagcacagtccctgcttttgactgggttcctattttaagcacaaatgagagctctggagccagaatgccagggttctaacttcagcattcacttactagctgtatgatcttggccaagtcacttcacctccctgagccccaattcccaagtttgtgaaatggcaacaatacctatgtgtcactggattattggttaaaacagaatgagattccttgtgtgaaaatagctattatacctgacacactcatcgtatgggctctgcaaagggatattccccaacctgtccttcctgacaggaagcatagggcactgcagatggggaagcatgtcaccttggcagtgactcggtggcttcccaagcaggagtgtcaggggaaccatgagagagagtctaggagcaaacacatcaccaccctgagcagatacaggagtggggagggggctgtaactcagtgagtggcttccaggggccccaggccctgctggatgtgggccaagccctacagcttccctaggcagtaagtaaaaacattctcctagcattaaaatggtttccataa

SEQ ID NO: 85 - protein, 138 aa, Homosapien
MAELQQLRVQEAMESMVKSLERENIRKMQGLMFRCSASCCEDSQASMKQVHQCIERCHVPLAQAQALVTSELEKFQDRLARCTMHCNDKAKDSIDAGSKELQVKQQLDSCVTKCVDDHMHLIPTMTKKMKEALLSIGK

SEQ ID NO: 86 - DNA, 1786 bp, Homosapien
gtacgccgattccatatgggcgccggcgcggagcgccgcggggcagcgcggggtcgccatggctgagctgcagcagctccgggtgcaggaggcgatggagtccatggtgaagagtctggaaagagagaacatccggaagatgcagggtctcatgttccggtgcagcgccagctgttgtgaggacagccaggcctccatgaagcaggtgcaccagtgcatcgagcgctgccatgtgcctctggctcaagcccaggctttggtcaccagtgagctggagaagttccaggaccgcctggcccggtgcaccatgcattgcaatgacaaagccaaagattcaatagatgctgggagtaaggagcttcaggtgaagcagcagctggacagttgtgtgaccaagtgtgtggatgaccacatgcacctcatcccaactatgaccaagaagatgaaggaggctctcttatcaattggaaaataaaagtatttgccagtggccatcaggctgagggcaagaatatattttttataaggaattgggaattttagtcttttaagcaaagtttacgaatgaagaaatgaaggatggccacaagcgtaaggcatatgtcacttgcctctggacactggttattttatgtttcagtccctaaaaaatgaaatggaaaaaagtggtgctaaatcgagtcagagatattacaggagagttttagagcttattatttcctgtggccagtgcttgtcctggcagtaaggctctcccctgtaacaagccagagccctccaaggtaccagactcttcttactacacaggtactaacaggctggcaggttagagttggtggagtctgaggagagatattttctctttgttgccaacatcctgtttaccaaaagtgtcaccccaccatcttccataagctgtgaaacaaaatcaatgaggtcactaacttagaagggaaagaaagttttctgggtctttgttttcttgatttggggtaatttatacaagggcatacaagttgattttaagatgtggaactgggaggtagactagtttggataagaactttgaaatgttccttgtggatccccatttctggtcatcaagatgtggatgtacatttcttaaaattattacatgctgcatctttcagcctggagactgtgcagaaacatgagaggtgatgacacactaattatgggaagcagaattactggctgatggcccctgaggctgtgtgtaacaaaatgacaggacaatcttgcagtaacactttccccttgaagagaagggggttttgattgtgatatatactagtatctaggaatgaacagtaaaagaggagcagttggctacttgattacaacagagtaaatgaagtactggatttgggaaaacctggttttattagaacatatggaatgaaagcctacacctagcattgcctacttagccccctgaattaacagagcccaattgagacaaacccctggcaacaggaaattcaagggagaaaaagtaagcaacttgggctaggatgagctgactcccttagagcaaaggagagacagcccccattaccaaataccatttttgcctggggcttgtgcagctggcagtgttcctgccccagcatggcaccttattgttttgatagcaacttcgttgaattttcaccaacttattacttgaaattataatatagcctgtccgtttgctgtttccaggctgtgatatattttcctagtggtttgactttaaaaataaataaggtttaattttctcccc

SEQ ID NO: 87 - protein, 106 aa, Homosapien
MATPGPVIPEVPFEPSKPPVIEGLSPTVYRNPESFKEKFVRKTRENPVVPIGCLATAAALTYGLYSFHRGNSQRSQLMMRTRIAAQGFTVAAILLGLAVTAMKSRP

SEQ ID NO: 88 - DNA, 628 bp, Homosapien
cggagtcccgattttctcctgctgctgtggcccggacatggcgactcccggccctgtgattccggaggtcccctttgaaccatcgaagcctccagtcattgaggggctgagccccactgtttacaggaatccagagagtttcaaggaaaagttcgttcgcaagacccgcgagaacccggtggtacccataggttgcctggccacggcggccgccctcacctacggcctctactccttccaccggggcaacagccagcgctctcagctcatgatgcgcacccggatcgccgcccagggtttcacggtcgcagccatcttgctgggtctggctgtcactgctatgaagtctcgaccctaagcccagggtctggccttgaaagctccgcagaaatgattccaaaacccagggagcaaccactggccctaccgtgggacttactccctcctctcctttgagaggcccatgtgtcgctggggaggaagtgaccctttgtgtaactgtaaccgaaagttttttcaaaaatcctagatgctgttgtttgaatgttacatacttctatttgtgccacatctcccctccactcccctgcttaataaactctaaaaatccaaaaaaaaaaaaaaaaaa

SEQ ID NO: 89 - protein, 153 aa, Homosapien
MNVGVAHSEVNPNTRVMNSRGIWLAYIILVGLLHMVLLSIPFFSIPVVWTLTNVIHNLATYVFLHTVKGTPFETPDQGKARLLTHWEQMDYGLQFTSSRKFLSISPIVLYLLASFYTKYDAAHFLINTASLLSVLLPKLPQFHGVRVFGINKY

SEQ ID NO: 90 - DNA, 1361 bp, Homosapien
aaggggcagaaggagaggcgttacttcctggagacttcaggtgtggtagccggcgccgcgcccatagccggacggggatctgagctggcaggatgaatgtgggggtggcacacagcgaagtaaaccccaacacccgagtgatgaatagccgaggcatctggctggcctacatcatcttggtaggattgctgcatatggttctactcagcatccccttcttcagcattcctgttgtctggaccctgaccaacgtcatccataacctggctacgtatgtcttccttcatacggtgaaagggacaccctttgagactcctgaccaaggaaaggctcggctactgacacactgggagcaaatggactatgggctccagtttacctcttcccgcaagttcctcagcatctctcctattgtgctctatctcctggccagcttctataccaagtatgatgctgcgcacttcctcatcaacacagcctcattgctaagtgtactgctgccgaagttgccccagttccatggggttcgtgtctttggcatcaacaaatactgagggatgggttttgggacagctccatgggcatggggaaggcactgaaacagaggactataaaacatccttctcttattctccatactgtcttctacacctttaaagcctgagaactatacaacctttcccagactcccaagaagagaagagattggcaaatggggctcctgggcccagtcctgctagtggcaagtttctttgaatcaggaaggcaggtgaggtaagggccaaatcactctcctccatagcaggaagccatttgggcagcttctttggtgattacatctttccatatcttttacacttaccaccttccagctctgttttgctgtgtatttttcttacaataatttttttcagctatagctgcagtttaatcaggatgggtagagagctgtcctcataaggctgggggtgggaagatggaatactgacctaatgtataaaacttaaaacaattctccaatcccctctcctttggtccagtaggaggtgcccttcactctaagcttaacacttagtagggaagagattctcaaatgagaaaaagggctccggctatatgggcaacaaagagggaagatacaggttgccagttatacatttatagaaagataatcccctggctttaaatagtcatgtacatacaaatatgaacaaacttaaaaaaaaaatacaaacccttggatcacatgggggcttctgggaacccccgtattcttccccctcacccaagggcagtgggcatgaatctactttttaaaaatgattaattttggcaaaaaaaaaaaaaaaaaaaaaaaaaaa

SEQ ID NO: 91 - protein, 81 aa, Homosapien
MAAVAAASAELLIIGWYIFRVLLQVFLECCIYWVGFAFRNPPGTQPIARSEVFRYSLQKLAYTVSRTGRQVLGERRQRAPN

SEQ ID NO: 92 - protein, 54 aa, Homosapien
MAAVAAASAELLIIGWYIFRVLLQVFRYSLQKLAYTVSRTGRQVLGERRQRAPN

SEQ ID NO: 93 - DNA, 1338 bp, Homosapien
taggtggcgggcgggtacttaaggcgcggccaccgcggctgcggcagtgcgcccaacagcggactccgagaccagcggatctcggcaaaccctctttctcgaccacccacctaccattcttggaaccatggcggcagtggcggcggcctcggctgaactgctcatcatcggctggtacatcttccgcgtgctgctgcaggtgttcctggaatgctgcatttactgggtaggattcgcttttcgaaatcctccagggacacagcccattgcgagaagtgaggtgttcaggtactccctgcagaagctggcatacacggtgtcgcggaccgggcggcaggtgttgggggagcgcaggcagcgagcccccaactgaggccccagctcccagccctgggcggccgtatcatcaggtgctcctgtgcatctcggccagcacgggagccagtgccgcgcaggaatgtggggtcccctgtgttccctcgccagaggagcacttggcaaggtcagtgaggggccagtagacccccggagaagcagtaccgacaatgacgaagataccagatcccttcccaacccctttgcaccggtcccactaaggggcagggtcgagagaggaggggggatagggggagcagacccctgagatctgggcataggcaccgcattctgatctggacaaagtcgggacagcaccatcccagccccgaagccagggccatgccagcaggccccaccatggaaatcaaaacaccgcaccagccagcagaatggacattctgacatcgccagccgacgccctgaatcttggtgcagcaccaaccgcgtgcctgtgtggcgggactggagggcacagttgaggaaggagggtggttaagaaatacagtggggccctctcgctgtcccttgcccagggcacttgcattccagcctcgctgcatttgctctctcgattcccctttcctcctcactgcctcccaagcccaccctactccaaaataatgtgtcacttgatttggaactattcaagcagtaaaagtaaatgaatcccacctttactaaaacactttctctgaaccccccttgcccctcactgatcttgcttttccctggtctcatgcagttgtggtcaatattgtggtaatcgctaattgtactgattgtttaagtgtgcattagttgtgtctccccagctagattgtaagctcctggaggacagggaccacctctacaaaaaataaaaaaagtacctcccctgtctcgcacagtgtcccaggaccctgcggtgcagtagaggcgcaccaaaaaaaaaaaaaaaaaaaaaaaaaaaaaaaaaaaaaa

SEQ ID NO: 94 - DNA, 1257 bp, Homosapien
taggtggcgggcgggtacttaaggcgcggccaccgcggctgcggcagtgcgcccaacagcggactccgagaccagcggatctcggcaaaccctctttctcgaccacccacctaccattcttggaaccatggcggcagtggcggcggcctcggctgaactgctcatcatcggctggtacatcttccgcgtgctgctgcaggtgttcaggtactccctgcagaagctggcatacacggtgtcgcggaccgggcggcaggtgttgggggagcgcaggcagcgagcccccaactgaggccccagctcccagccctgggcggccgtatcatcaggtgctcctgtgcatctcggccagcacgggagccagtgccgcgcaggaatgtggggtcccctgtgttccctcgccagaggagcacttggcaaggtcagtgaggggccagtagacccccggagaagcagtaccgacaatgacgaagataccagatcccttcccaacccctttgcaccggtcccactaaggggcagggtcgagagaggaggggggatagggggagcagacccctgagatctgggcataggcaccgcattctgatctggacaaagtcgggacagcaccatcccagccccgaagccagggccatgccagcaggccccaccatggaaatcaaaacaccgcaccagccagcagaatggacattctgacatcgccagccgacgccctgaatcttggtgcagcaccaaccgcgtgcctgtgtggcgggactggagggcacagttgaggaaggagggtggttaagaaatacagtggggccctctcgctgtcccttgcccagggcacttgcattccagcctcgctgcatttgctctctcgattcccctttcctcctcactgcctcccaagcccaccctactccaaaataatgtgtcacttgatttggaactattcaagcagtaaaagtaaatgaatcccacctttactaaaacactttctctgaaccccccttgcccctcactgatcttgcttttccctggtctcatgcagttgtggtcaatattgtggtaatcgctaattgtactgattgtttaagtgtgcattagttgtgtctccccagctagattgtaagctcctggaggacagggaccacctctacaaaaaataaaaaaagtacctcccctgtctcgcacagtgtcccaggaccctgcggtgcagtagaggcgcaccaaaaaaaaaaaaaaaaaaaaaaaaaaaaaaaaaaaaaa

SEQ ID NO: 95 - protein, 61 aa, Homosapien
MKRFLFLLLTISLLVMVQIQTGLSGQNDTSQTSSPSASSNISGGIFLFFVANAIIHLFCFS

SEQ ID NO: 96 - DNA, 523 bp, Homosapien
ctcctggttcaaaagcagctaaaccaaaagaagcctccagacagccctgagatcacctaaaaagctgctaccaagacagccacgaagatcctaccaaaatgaagcgcttcctcttcctcctactcaccatcagcctcctggttatggtacagatacaaactggactctcaggacaaaacgacaccagccaaaccagcagcccctcagcatccagcaacataagcggaggcattttccttttcttcgtggccaatgccataatccacctcttctgcttcagttgaggtgacacgtctcagccttagccctgtgccccctgaaacagctgccaccatcactcgcaagagaatcccctccatctttgggaggggttgatgccagacatcaccaggttgtagaagttgacaggcagtgccatgggggcaacagccaaaataggggggtaatgatgtaggggccaagcagtgcccagctgggggtcaataaagttacccttgtacttgcaaaaaaaaaaaaaaaaaaa

SEQ ID NO: 97 - protein, 153 aa, Homosapien
MNVGTAHSEVNPNTRVMNSRGIWLSYVLAIGLLHIVLLSIPFVSVPVVWTLTNLIHNMGMYIFLHTVKGTPFETPDQGKARLLTHWEQMDYGVQFTASRKFLTITPIVLYFLTSFYTKYDQIHFVLNTVSLMSVLIPKLPQLHGVRIFGINKY

SEQ ID NO: 98 - DNA, 2109 bp, Homosapien
gattcggccggagctgccagcggggaggctgcagccgcgggttgttacagctgctggagcagcagcggcccccgctcccgggaaccgttcccgggccgttgatcttcggccccacacgaacagcagagaggggcagcaggatgaatgtgggcacagcgcacagcgaggtgaaccccaacacgcgggtgatgaacagccgtggcatctggctctcctacgtgctggccatcggtctcctccacatcgtgctgctgagcatcccgtttgtgagtgtccctgtcgtctggaccctcaccaacctcattcacaacatgggcatgtatatcttcctgcacacggtgaaggggacaccctttgagaccccggaccagggcaaggcgaggctgctaacccactgggagcagatggattatggggtccagttcacggcctctcggaagttcttgaccatcacacccatcgtgctgtacttcctcaccagcttctacactaagtacgaccagatccattttgtgctcaacaccgtgtccctgatgagcgtgcttatccccaagctgccccagctccacggagtccggatttttggaatcaataagtactgagagtgcagccccttcccctgcccagggtggcaggggaggggtagggtaaaaggcatgtgctgcaacactgaagacagaaagaagaagcctctggacactgccagagatgggggttgagcctctggcctaatttcccccctcgcttcccccagtagccaacttggagtagcttgtagtggggttggggtaggccccctgggctctgaccttttctgaattttttgatctcttccttttgctttttgaatagagactccatggagttggtcatggaatgggctgggctcctgggctgaacatggaccacgcagttgcgacaggaggccaggggaaaaacccctgctcacttgtttgccctcaggcagccaaagcactttaacccctgcatagggagcagagggcggtacggcttctggattgtttcactgtgattcctaggttttttcgatgccatgcagtgtgtgcttttgtgtatggaagcaagtgtgggatgggtctttgcctttctgggtagggagctgtctaatccaagtcccaggcttttggcagcttctctgcaacccaccgtgggtcctggttgggagtggggagggtcaggttggggaaagatggggtagagtgtagatggcttggttccagaggtgagggggccagggctgctgccatcctggcctggtggaggttggggagctgtaggagagctagtgagtcgagacttagaagaatggggccacatagcagcagaggactggtgtaagggagggaggggtagggacagaagctagacccaatctcctttgggatgtgggcagggagggaagcaggcttggagggttaatttacccacagaatgtgatagtaataggggagggaggctgctgtgggtttaactcctgggttggctgttgggtagacaggtggggaaaaggcccgtgagtcattgtaagcacaggtccaacttggccctgactcctgcgggggtatggggaagctgtgacagaaacgatgggtgctgtggtcctctgcaggccctcaccccttaacttcctcatgcagactggcactgggcagggcctctcatgtggcagccacatgtggcgttgtgaggccaccccatgtggggtctgtggtgagagtcctgtaggatccctgctcaagcagcacagaggaaggggcaagacgtggcctgtaggcactgtctcagcctgcagagaagaaagtgaggccgggagcctgagcctgggctggagccttctcccctccccagttggactaggggcagtgttaattttgaaaaggtgtgggtccctgtgtccttttccaggggtccaagggaacaggagaggtcactgggcctgttttctccctcctgaccctgcatctcccaccctgtgtatcatagggaactttcaccttaaaatctttctaagcaaagtgtgaataggatttttactccctttgtacagtattctgaggaacgcaaataaaagggcaacatgtttctgtt

SEQ ID NO: 99 - protein, 847 aa, Homosapien
MEPLKSLFLKSPLGSWNGSGSGGGGGGGGGRPEGSPKAAGYANPVWTALFDYEPSGQDELALRKGDRVEVLSRDAAISGDEGWWAGQVGGQVGIFPSNYVSRGGGPPPCEVASFQELRLEEVIGIGGFGKVYRGSWRGELVAVKAARQDPDEDISVTAESVRQEARLFAMLAHPNIIALKAVCLEEPNLCLVMEYAAGGPLSRALAGRRVPPHVLVNWAVQIARGMHYLHCEALVPVIHRDLKSNNILLLQPIESDDMEHKTLKITDFGLAREWHKTTQMSAAGTYAWMAPEVIKASTFSKGSDVWSFGVLLWELLTGEVPYRGIDCLAVAYGVAVNKLTLPIPSTCPEPFAQLMADCWAQDPHRRPDFASILQQLEALEAQVLREMPRDSFHSMQEGWKREIQGLFDELRAKEKELLSREEELTRAAREQRSQAEQLRRREHLLAQWELEVFERELTLLLQQVDRERPHVRRRRGTFKRSKLRARDGGERISMPLDFKHRITVQASPGLDRRRNVFEVGPGDSPTFPRFRAIQLEPAEPGQAWGRQSPRRLEDSSNGERRACWAWGPSSPKPGEAQNGRRRSRMDEATWYLDSDDSSPLGSPSTPPALNGNPPRPSLEPEEPKRPVPAERGSSSGTPKLIQRALLRGTALLASLGLGRDLQPPGGPGRERGESPTTPPTPTPAPCPTEPPPSPLICFSLKTPDSPPTPAPLLLDLGIPVGQRSAKSPRREEEPRGGTVSPPPGTSRSAPGTPGTPRSPPLGLISRPRPSPLRSRIDPWSFVSAGPRPSPLPSPQPAPRRAPWTLFPDSDPFWDSPPANPFQGGPQDCRAQTKDMGAQAPWVPEAGP

SEQ ID NO: 100 - DNA, 3574 bp, Homosapien
acaaagggaggaggaagaagggagcggggtcggagccgtcggggccaaaggagacggggccaggaacaggcagtctcggcccaactgcggacgctccctccaccccctgcgcaaaaagacccaaccggagttgaggcgctgcccctgaaggccccaccttacacttggcgggggccggagccaggctcccaggactgctccagaaccgagggaagctcgggtccctccaagctagccatggtgaggcgccggaggccccggggccccacccccccggcctgaccacactgccctgggtgccctcctccagaagcccgagatgcggggggccgggagacaacactcctggctccccagagaggcgtgggtctggggctgagggccagggcccggatgcccaggttccgggactagggccttggcagccagcgggggtggggaccacgggcacccagagaaggtcctccacacatcccagcgccggctcccggccatggagcccttgaagagcctcttcctcaagagccctctagggtcatggaatggcagtggcagcgggggtggtgggggcggtggaggaggccggcctgaggggtctccaaaggcagcgggttatgccaacccggtgtggacagccctgttcgactacgagcccagtgggcaggatgagctggccctgaggaagggtgaccgtgtggaggtgctgtcccgggacgcagccatctcaggagacgagggctggtgggcgggccaggtgggtggccaggtgggcatcttcccgtccaactatgtgtctcggggtggcggcccgcccccctgcgaggtggccagcttccaggagctgcggctggaggaggtgatcggcattggaggctttggcaaggtgtacaggggcagctggcgaggtgagctggtggctgtgaaggcagctcgccaggaccccgatgaggacatcagtgtgacagccgagagcgttcgccaggaggcccggctcttcgccatgctggcacaccccaacatcattgccctcaaggctgtgtgcctggaggagcccaacctgtgcctggtgatggagtatgcagccggtgggcccctcagccgagctctggccgggcggcgcgtgcctccccatgtgctggtcaactgggctgtgcagattgcccgtgggatgcactacctgcactgcgaggccctggtgcccgtcatccaccgtgatctcaagtccaacaacattttgctgctgcagcccattgagagtgacgacatggagcacaagaccctgaagatcaccgactttggcctggcccgagagtggcacaaaaccacacaaatgagtgccgcgggcacctacgcctggatggctcctgaggttatcaaggcctccaccttctctaagggcagtgacgtctggagttttggggtgctgctgtgggaactgctgaccggggaggtgccataccgtggcattgactgccttgctgtggcctatggcgtagctgttaacaagctcacactgcccatcccatccacctgccccgagcccttcgcacagcttatggccgactgctgggcgcaggacccccaccgcaggcccgacttcgcctccatcctgcagcagttggaggcgctggaggcacaggtcctacgggaaatgccgcgggactccttccattccatgcaggaaggctggaagcgcgagatccagggtctcttcgacgagctgcgagccaaggaaaaggaactactgagccgcgaggaggagctgacgcgagcggcgcgcgagcagcggtcacaggcggagcagctgcggcggcgcgagcacctgctggcccagtgggagctagaggtgttcgagcgcgagctgacgctgctgctgcagcaggtggaccgcgagcgaccgcacgtgcgccgccgccgcgggacattcaagcgcagcaagctccgggcgcgcgacggcggcgagcgtatcagcatgccactcgacttcaagcaccgcatcaccgtgcaggcctcacccggccttgaccggaggagaaacgtcttcgaggtcgggcctggggattcgcccacctttccccggttccgagccatccagttggagcctgcagagccaggccaggcatggggccgccagtccccccgacgtctggaggactcaagcaatggagagcggcgagcatgctgggcttggggtcccagttcccccaagcctggggaagcccagaatgggaggagaaggtcccgcatggacgaagccacatggtacctggattcagatgactcatcccccttaggatctccttccacacccccagcactcaatggtaaccccccgcggcctagcctggagcccgaggagcccaagaggcctgtccccgcagagcgcggtagcagctctgggacgcccaagctgatccagcgggcgctgctgcgcggcaccgccctgctcgcctcgctgggccttggccgcgacctgcagccgccgggaggcccaggacgcgagcgcggggagtccccgacaacaccccccacgccaacgcccgcgccctgcccgaccgagccgcccccttccccgctcatctgcttctcgctcaagacgcccgactccccgcccactcctgcacccctgttgctggacctgggtatccctgtgggccagcggtcagccaagagcccccgacgtgaggaggagccccgcggaggcactgtctcacccccaccggggacatcacgctctgctcctggcaccccaggcaccccacgttcaccacccctgggcctcatcagccgacctcggccctcgccccttcgcagccgcattgatccctggagctttgtgtcagctgggccacggccttctcccctgccatcaccacagcctgcaccccgccgagcaccctggaccttgttcccggactcagaccccttctgggactccccacctgccaaccccttccaggggggcccccaggactgcagggcacagaccaaagacatgggtgcccaggccccgtgggtgccggaagcggggccttgagtgggccaggccactcccccgagctccagctgccttaggaggagtcacagcatacactggaacaggagctgggtcagcctctgcagctgcctcagtttccccagggaccccacccccctttgggggtcaggaacactacactgcacaggaagccttcacactggaagggggacctgcgcccccacatctgaaacctgtaggtccccccagctcacctgccctactggggcccaacactgtacccagctggttgggaggaccagagcctgtctcagggaattgcctgctggggtgatgcagggaggaggggaggtgcagggaagaggggccggcctcagctgtcaccagcacttttgaccaagtcctgctactgcggcccctgccctagggcttagagcatggacctcctgccctgggggtcatctggggccagggctctctggatgccttcctgctgccccagccagggttggagtcttagcctcgggatccagtgaagccagaagccaaataaactcaaaagctgtctccccacaa

SEQ ID NO: 101 - protein, 445 aa, Homosapien
MAAPEERDLTQEQTEKLLQFQDLTGIESMDQCRHTLEQHNWNIEAAVQDRLNEQEGVPSVFNPPPSRPLQVNTADHRIYSYVVSRPQPRGLLGWGYYLIMLPFRFTYYTILDIFRFALRFIRPDPRSRVTDPVGDIVSFMHSFEEKYGRAHPVFYQGTYSQALNDAKRELRFLLVYLHGDDHQDSDEFCRNTLCAPEVISLINTRMLFWACSTNKPEGYRVSQALRENTYPFLAMIMLKDRRMTVVGRLEGLIQPDDLINQLTFIMDANQTYLVSERLEREERNQTQVLRQQQDEAYLASLRADQEKERKKREERERKRRKEEEVQQQKLAEERRRQNLQEEKERKLECLPPEPSPDDPESVKIIFKLPNDSRVERRFHFSQSLTVIHDFLFSLKESPEKFQIEANFPRRVLPCIPSEEWPNPPTLQEAGLSHTEVLFVQDLTDE

SEQ ID NO: 102 - DNA, 4515 bp, Homosapien
agttccggcgggtgacggtgcggacgggtcaggagcgtagaggcggcggcaaaatggcggcgcctgaggagcgggatctaacccaggagcagacagagaagctgctgcagtttcaggatctcactggcatcgaatctatggatcagtgtcgccataccttggaacagcataactggaacatagaggctgctgtacaggacagattgaatgagcaagagggcgtacctagtgttttcaacccacctccatcacgacccctgcaggttaatacagctgaccacaggatctacagctatgttgtctcaagacctcaaccaagggggctgcttggatggggttattacttgataatgcttccattccggtttacctattacacgatacttgatatatttaggtttgctcttcgttttatacggcctgaccctcgcagccgggtcactgaccccgttggggacattgtttcatttatgcactcttttgaagagaaatatgggagggcacaccctgtcttctaccagggaacgtacagccaggcacttaacgatgccaaaagggagcttcgctttcttttggtttatcttcatggagatgatcaccaggactctgatgagttttgtcgcaacacactctgtgcacctgaagttatttcactaataaacactaggatgctcttctgggcatgctctacaaacaaacctgagggatacagggtctcacaggctttacgagagaacacctatccattcctggccatgattatgctgaaggatcgaaggatgactgtggtgggacggctagaaggcctcattcaacctgatgacctcattaaccaactgacatttatcatggatgctaaccagacttacctggtgtcagaacgcctagaaagggaagaaagaaaccagacccaagtgctgagacaacagcaggatgaggcctacctggcctctctcagagctgaccaggagaaagaaagaaagaaacgggaggagcgggagcgtaagcggcggaaggaggaggaggtgcaacagcaaaagttggcagaggagagacggcggcagaatttacaggaggaaaaggaaaggaagttggaatgcctgccccctgaaccttcccctgatgaccctgaaagtgtcaagatcatcttcaaattacctaatgattctcgagtagagagacgattccacttttcacagtctctaacagtaatccacgacttcttattctccttgaaggaaagcccagaaaagtttcagattgaagccaattttcccaggcgagtgctgccctgcatcccttcagaggagtggcccaatccccctacgctacaggaggccggactcagccacacagaagttctttttgttcaggacctaactgacgaatgacatttttttcttcctgtcccctcctaccccagtccctaaaagaaatggggaaaaaagaaaacaacagcaagtcagaaaaaaaaaacaagagagagaaattcatattattattattattataatacaatattttttttaaaagactgctgcatccttaggaaggatcagaaaccatgctgcccgtaagagtcacaacctgtgtgtgcgcgcaaggttagcaacaaacgtacccgcttggcaagcccacccttcctgtggcctctgtgcacgcaccttccagtgaacagagactcttcaccttcgacccatccattgtcccagctgggaaggggacattcccactagttctcattcattcttgcttttatgaaaaataaaagtgaaaaacctccatcaaccagctacttgcagcatctcctgaggacttgcttctcctgcctctggggaagagagggaagagaaagcacagagcagagaagcagagatgttccttgaactgcccacaagttttcaataacttttatttctgttttgtaatgaccaaaggaatgaggctgacataggtatatatatatatttttttcctttatttgataaagagccaattctttaaacccatgagtttatgccctgggctccttagcccacaatagtgtaataaaagtgccccgggctggtttgtgcttatttctgccattgtccctctcacgttcccagagaggtcattctttttggtccaactcttgctgtcctttcttaccacctgtgcaccccacttggagcagtgggaggaaatctgggtttgtggccccacaaaggctgtatatgtaaagatacacctatgtatgtggtggaactcacctttacacacaactgcagcttttccttggagtctgtaccaggtggtggttatggggtctgaaccaaaggatagcagctcttcattcctcttctgacatgtgcatgctgctccccccagccctgggctttcctgaattgccaagcctggtgcctttccaaaggactagcagggcctgtggtggagccagcagaaccacaggagagtgccctgcctgtctcagtggaagtgtattattgttttaaggatagaaccagaggccttgaagggagccaagacagaactcccagcctgtgtaatctattggaaggcacattttcatttctgatgcagccaccttctggaggcagcttttatcctttctctctattgctatgttgaagtaatagggttttttttaacctctggatgtctcgtctgtggttgagtttatggtaatgggtacatgggtcaggccatgtattaacagatgccagtgcgctctgacaagtattccaaagtgttctgtagctagactggtgcaggctcgttgtaccactgcaaccgactgacgttactgtagttcctagaatgctgtgagggcggggggttcagatcaacataaagcctaacttgctggagttgtagtctcaaggctttctctcttgcttaactaaaacctaaggaccactgtttttggtagcaattatatggttactatccactgcagtcctcagttgttggggtaaatcccacatggcagagtaaggcaccccacagaaattaacttggagagcctgagaaattcccagtggccttggcatagctgtctagaacaccatctctaggaaaatttaattctgtccctggccagctattgttcttccacttcgttttctgctgtcccaaggccagatgagtggaatcaccatctgactgctgtcaataaaatgtatctggcgtgaacagcaggataacccatgttctccacataaggataaccttacgtgaaaccttcctgctgacaaccatgcagaggaatttttccacttaagtcagagccttcctccccatctggaattcacagctgttccctggcagcacacaggagggtattaaggacctttgtgaggctaggtacactgtccacacctctttggggaagttacgattttttttttccatcataattcagtctcttcttattctacagtgtgcactttatgcctctcgccttttgataatagttgttcagtgaaggaagtcagctgccagaatattaagaagggtctccctttatgtcagtacaactgttagggcggccttcccatttactttaggtttcaagaggattcaccggaagcacatgccccggtctagtcccatttgaaacagttctgctttactgagaccctaggccggtctccttgctgaccctagcgctgctgcctaggtgccatttcctttcctcctcagtcaaatacaggctgcacattttgtcacttaatgccagtacaatctgtgttactcctaaggacttttgggattttgatgagacctgcgagggagaagacactgagaagccagtgatctgcaagcatttgctcttgtttccacatcacctctgggatatttcagctgttgtttccaaatggcaaatcatcaactaaaagcacttgtttcaagttttgttctgcactcccacgactgaagttgtagattgagctgaataaccatgggaagtgaccaagcaaagacactcgattggagtcagttgaatatttgtaccctcagtggagcccttctggtcttttcttccacttctgcagaatttcctctagcaaatacttctttctccttgcttgcctccaccatgatatttgaataagagatggccagaggataacacttgtctcttaaaaactaagctaaaaagaacctagaaccttcaattgagcagttgtgaaaattgctaatggtgccaaggccaagcaaagagtttcagaaaatgactgagaaggagcgataacccccagaatgcaaaatcaggggcatcattatccggtgcttgaacaaggagctccgctctacaactggtttttttaggacttgtgaggaacacagcaacggaaatccatccacaaaggatgcagtgccccaacttgtactgcgcctgaatagtcatgtgataatttactgaagaaatctagtgtactttaaatttttttcataaaagtttacattgtattgtaggttaacattaaatgttttatagcaaaaacttca

SEQ ID NO: 103 - protein, 359 aa, Homosapien
MMLSLNNLQNIIYNPVIPFVGTIPDQLDPGTLIVIRGHVPSDADRFQVDLQNGSSMKPRADVAFHFNPRFKRAGCIVCNTLINEKWGREEITYDTPFKREKSFEIVIMVLKDKFQVAVNGKHTLLYGHRIGPEKIDTLGIYGKVNIHSIGFSFSSDLQSTQASSLELTEISRENVPKSGTPQLPSNRGGDISKIAPRTVYTKSKDSTVNHTLTCTKIPPMNYVSKRLPFAARLNTPMGPGRTVVVKGEVNANAKSFNVDLLAGKSKDIALHLNPRLNIKAFVRNSFLQESWGEEERNITSFPFSPGMYFEMIIYCDVREFKVAVNGVHSLEYKHRFKELSSIDTLEINGDIHLLEVRSW

SEQ ID NO: 104 - DNA, 1080 bp, Homosapien
atgatgttgtccttaaacaacctacagaatatcatctataacccggtaatcccgtttgttggcaccattcctgatcagctggatcctggaactttgattgtgatacgtgggcatgttcctagtgacgcagacagattccaggtggatctgcagaatggcagcagcatgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctgaaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatgttccaaagtctggcacgccccagcttcctagtaatagaggaggagacatttctaaaatcgcacccagaactgtctacaccaagagcaaagattcgactgtcaatcacactttgacttgcaccaaaataccacctatgaactatgtgtcaaagaggctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttattgtgatgttagagaattcaaggttgcagtaaatggcgtacacagcctggagtacaaacacagatttaaagagctcagcagtattgacacgctggaaattaatggagacatccacttactggaagtaaggagctggtag

SEQ ID NO: 105 - protein, 153 aa, Homosapien
MNVGVAHSEVNPNTRVMNSRGMWLTYALGVGLLHIVLLSIPFFSVPVAWTLTNIIHNLGMYVFLHAVKGTPFETPDQGKARLLTHWEQLDYGVQFTSSRKFFTISPIILYFLASFYTKYDPTHFILNTASLLSVLIPKMPQLHGVRIFGINKY

SEQ ID NO: 106 - DNA, 459 bp, Homosapien
atgaacgttggagttgcccacagtgaagtgaatccaaatacccgtgtcatgaacagccggggtatgtggctgacatatgcattgggagttggcttgcttcatattgtcttactcagcattcccttcttcagtgttcctgttgcttggactttaacaaatattatacataatctggggatgtacgtatttttgcatgcagtgaaaggaacacctttcgaaactcctgaccagggtaaagcaaggctcctaactcattgggaacaactggactatggagtacagtttacatcttcacggaagtttttcacaatttctccaataattctatattttctggcaagtttctatacgaagtatgatccaactcacttcatcctaaacacagcttctctcctgagtgtactaattcccaaaatgccacaactacatggtgttcggatctttggaattaataagtat

SEQ ID NO: 107 - protein, 58 aa, Homosapien
MQMFPPSPLFFFLQLLKQSSRRLEHTFVFLRNFSLMLLRYIGKKRRATRFWDPRRGTP

SEQ ID NO: 108 - DNA, 177 bp, Homosapien
atgcagatgtttcccccaagcccactatttttcttccttcaattgctgaaacaaagctccagaaggctggaacatacctttgtcttcttgagaaatttttccctgatgttattaagatacattggcaagaaaagaagagcaacacgattctgggatcccaggaggggaacaccatga

SEQ ID NO: 109 - protein, 455 aa, Homosapien
MGACLGACSLLSCASCLCGSAPCILCSCCPASRNSTVSRLIFTFFLFLGVLVSIIMLSPGVESQLYKLPWVCEEGAGIPTVLQGHIDCGSLLGYRAVYRMCFATAAFFFFFTLLMLCVSSSRDPRAAIQNGFWFFKFLILVGLTVGAFYIPDGSFTNIWFYFGVVGSFLFILIQLVLLIDFAHSWNQRWLGKAEECDSRAWYAGLFFFTLLFYLLSIAAVALMFMYYTEPSGCHEGKVFISLNLTFCVCVSIAAVLPKVQDAQPNSGLLQASVITLYTMFVTWSALSSIPEQKCNPHLPTQLGNETVVAGPEGYETQWWDAPSIVGLIIFLLCTLFISLRSSDHRQVNSLMQTEECPPMLDATQQQQQVAACEGRAFDNEQDGVTYSYSFFHFCLVLASLHVMMTLTNWYKPGETRKMISTWTAVWVKICASWAGLLLYLWTLVAPLLLRNRDFS

SEQ ID NO: 110 - DNA, 1368 bp, Homosapien
atgggggcctgcctgggagcctgctccctgctcagctgcgcgtcctgcctctgcggctctgccccctgcatcctgtgcagctgctgccccgccagccgcaactccaccgtgagccgcctcatcttcacgttcttcctcttcctgggggtgctggtgtccatcattatgctgagcccgggcgtggagagtcagctctacaagctgccctgggtgtgtgaggagggggccgggatccccaccgtcctgcagggccacatcgactgtggctccctgcttggctaccgcgctgtctaccgcatgtgcttcgccacggcggccttcttcttctttttcaccctgctcatgctctgcgtgagcagcagccgggacccccgggctgccatccagaatgggttttggttctttaagttcctgatcctggtgggcctcaccgtgggtgccttctacattcctgacggctccttcaccaacatctggttctacttcggcgtcgtgggctccttcctcttcatcctcatccagctggtgctgctcatcgactttgcgcactcctggaaccagcggtggctgggcaaggccgaggagtgcgattcccgtgcctggtacgcaggcctcttcttcttcactctcctcttctacttgctgtcgatcgcggccgtggcgctgatgttcatgtactacactgagcccagcggctgccacgagggcaaggtcttcatcagcctcaacctcaccttctgtgtctgcgtgtccatcgctgctgtcctgcccaaggtccaggacgcccagcccaactcgggtctgctgcaggcctcggtcatcaccctctacaccatgtttgtcacctggtcagccctatccagtatccctgaacagaaatgcaacccccatttgccaacccagctgggcaacgagacagttgtggcaggccccgagggctatgagacccagtggtgggatgccccgagcattgtgggcctcatcatcttcctcctgtgcaccctcttcatcagtctgcgctcctcagaccaccggcaggtgaacagcctgatgcagaccgaggagtgcccacctatgctagacgccacacagcagcagcagcaggtggcagcctgtgagggccgggcctttgacaacgagcaggacggcgtcacctacagctactccttcttccacttctgcctggtgctggcctcactgcacgtcatgatgacgctcaccaactggtacaagcccggtgagacccggaagatgatcagcacgtggaccgccgtgtgggtgaagatctgtgccagctgggcagggctgctcctctacctgtggaccctggtagccccactcctcctgcgcaaccgcgacttcagctga

SEQ ID NO: 111 - protein, 185 aa, Homosapien
MAPKGSSKQQSEEDLLLQDFSRNLSAKSSALFFGNAFIVSAIPIWLYWRIWHMDLIQSAVLYSVMTLVSTYLVAFAYKNVKFVLKHKVAQKREDAVSKEVTRKLSEADNRKMSRKEKDERILWKKNEVADYEATTFSIFYNNTLFLVVVIVASFFILKNFNPTVNYILSISASSGLIALLSTGSK

SEQ ID NO: 112 - DNA, 555 bp, Homosapien
atggctcctaaaggcagctccaaacagcagtctgaggaggacctgctcctgcaggatttcagccgcaatctctcggccaagtcctccgcgctcttcttcggaaacgcgttcatcgtgtctgccatccccatctggttatactggcgaatatggcatatggatcttattcagtctgctgttttgtatagtgtgatgaccctagtaagcacatatttggtagcctttgcatacaagaatgtgaaatttgttctcaagcacaaagtagcacagaagagggaggatgctgtttccaaagaagtgactcgaaaactttctgaagctgataatagaaagatgtctcggaaggagaaagatgaaagaatcttgtggaagaagaatgaagttgctgattatgaagctacaacattttccatcttctataacaacactctgttcctggtcgtggtcattgttgcttccttcttcatattgaagaacttcaaccccacagtgaactacatattgtccataagtgcttcatcaggactcatcgccctcctgtctactggctccaaa

SEQ ID NO: 113 - protein, 733 aa, Homosapien
MDLSMKKFAVRRFFSVYLRRKSRSKSSSLSRLEEEGVVKEIDISHHVKEGFEKADPSQFELLKVLGQGSYGKVFLVRKVKGSDAGQLYAMKVLKKATLKVRDRVRSKMERDILAEVNHPFIVKLHYAFQTEGKLYLILDFLRGGDLFTRLSKEVMFTEEDVKFYLAELALALDHLHSLGIIYRDLKPENILLDEEGHIKITDFGLSKEAIDHDKRAYSFCGTIEYMAPEVVNRRGHTQSADWWSFGVLMFEMLTGSLPFQGKDRKETMALILKAKLGMPQFLSGEAQSLLRALFKRNPCNRLGAGIDGVEEIKRHPFFVTIDWNTLYRKEIKPPFKPAVGRPEDTFHFDPEFTARTPTDSPGVPPSANAHHLFRGFSFVASSLIQEPSQQDLHKVPVHPIVQQLHGNNIHFTDGYEIKEDIGVGSYSVCKRCVHKATDTEYAVKIIDKSKRDPSEEIEILLRYGQHPNIITLKDVYDDGKFVYLVMELMRGGELLDRILRQRYFSEREASDVLCTITKTMDYLHSQGVVHRDLKPSNILYRDESGSPESIRVCDFGFAKQLRAGNGLLMTPCYTANFVAPEVLKRQGYDAACDIWSLGILLYTMLAGFTPFANGPDDTPEEILARIGSGKYALSGGNWDSISDAAKDVVSKMLHVDPHQRLTAMQVLKHPWVVNREYLSPNQLSRQDVHLVKGAMAATYFALNRTPQAPRLEPVLSSNLAQRRGMKRLTSTRL

SEQ ID NO: 114 - DNA, 2202 bp, Homosapien
atggacctgagcatgaagaagttcgccgtgcgcaggttcttctctgtgtacctgcgcaggaagtcgcgctccaagagctccagcctgagccggctcgaggaagaaggcgtcgtgaaggagatagacatcagccatcatgtgaaggagggctttgagaaggcagatccttcccagtttgagctgctgaaggttttaggacaaggatcctatggaaaggtgttcctggtgaggaaggtgaaggggtccgacgctgggcagctctacgccatgaaggtccttaagaaagccaccctaaaagttcgggaccgagtgagatcgaagatggagagagacatcttggcagaagtgaatcaccccttcattgtgaagcttcattatgcctttcagacggaaggaaagctctacctgatcctggacttcctgcggggaggggacctcttcacccggctctccaaagaggtcatgttcacggaggaggatgtcaagttctacctggctgagctggccttggctttagaccatctccacagcctggggatcatctacagagatctgaagcctgagaacatcctcctggatgaagaggggcacattaagatcacagatttcggcctgagtaaggaggccattgaccacgacaagagagcgtactccttctgcgggacgatcgagtacatggcgcccgaggtggtgaaccggcgaggacacacgcagagtgccgactggtggtccttcggcgtgctcatgtttgagatgctcacggggtccctgccgttccaggggaaggacaggaaggagaccatggctctcatcctcaaagccaagctggggatgccgcagttcctcagtggggaggcacagagtttgctgcgagctctcttcaaacggaacccctgcaaccggctgggtgctggcattgacggagtggaggaaattaagcgccatcccttctttgtgaccatagactggaacacgctgtaccggaaggagatcaagccaccgttcaaaccagcagtgggcaggcctgaggacaccttccactttgaccccgagttcacagcgcggacgcccacagactctcctggcgtccccccgagtgcaaacgctcatcacctgtttagaggattcagctttgtggcctcaagcctgatccaggagccctcacagcaagatctgcacaaagtcccagttcacccaatcgtgcagcagttacacgggaacaacatccacttcaccgatggctacgagatcaaggaggacatcggggtgggctcctactcagtgtgcaagcgatgtgtgcataaagccacagacaccgagtatgccgtgaagatcattgataagagcaagagagacccctcggaagagattgagatcctcctgcggtacggccagcacccgaacatcatcaccctcaaggatgtctatgatgatggcaagtttgtgtacctggtaatggagctgatgcgtggtggggagctcctggaccgcatcctccggcagagatacttctcggagcgcgaagccagtgacgtcctgtgcaccatcaccaagaccatggactacctccattcccagggggttgttcatcgagacctgaagccgagtaacatcctgtacagggatgagtcggggagcccagaatccatccgagtctgcgacttcggctttgccaagcagctgcgcgcggggaacgggctgctcatgacaccctgctacacggccaatttcgtggccccggaggtcctgaagcgtcaaggctatgatgcggcgtgtgacatctggagtttggggatcctgttgtacaccatgctggcaggatttaccccttttgcaaatgggccagacgatacccctgaggagattctggcgcggatcggcagtgggaagtatgccctttctgggggaaactgggactcgatatctgacgcagctaaagacgtcgtgtccaagatgctccacgtggaccctcatcagcgcctgacggcgatgcaagtgctcaaacacccgtgggtggtcaacagagagtacctgtccccaaaccagctcagccgacaggacgtgcacctggtgaagggcgcgatggccgccacctactttgctctaaacagaacacctcaggccccgcggctggagcccgtgctgtcatccaacctggctcagcgcagaggcatgaagagactcacgtccacgcggctgtag

SEQ ID NO: 115 - protein, 250 aa, Homosapien [sequence omitted]

SEQ ID NO: 116 - DNA, 753 bp, Homosapien
atggcagacaatttttcgctccatgatgcgttatctgggtctggaaacccaaaccctcaaggatggcctggcgcatgggggaaccagcctgctggggcagggggctacccaggggcttcctatcctggggcctaccccgggcaggcacccccaggggcttatcctggacaggcacctccaggcgcctaccctggagcacctggagcttatcccggagcacctgcacctggagtctacccagggccacccagcggccctggggcctacccatcttctggacagccaagtgccaccggagcctaccctgccactggcccctatggcgcccctgctgggccactgattgtgccttataacctgcctttgcctgggggagtggtgcctcgcatgctgataacaattctgggcacggtgaagcccaatgcaaacagaattgctttagatttccaaagagggaatgatgttgccttccactttaacccacgcttcaatgagaacaacaggagagtcattgtttgcaatacaaagctggataataactggggaagggaagaaagacagtcggttttcccatttgaaagtgggaaaccattcaaaatacaagtactggttgaacctgaccacttcaaggttgcagtgaatgatgctcacttgttgcagtacaatcatcgggttaaaaaactcaatgaaatcagcaaactgggaatttctggtgacatagacctcaccagtgcttcatataccatgatataa

SEQ ID NO: 117 - protein, 187 aa, Homosapien
MERQEESLSARPALETEGLRFLHTTVGSLLATYGWYIVFSCILLYVVFQKLSARLRALRQRQLDRAAAAVEPDVVVKRQEALAAARLKMQEELNAQVEKHKEKLKQLEEEKRRQKIEMWDSMQEGKSYKGNAKKPQEEDSPGPSTSSVLKRKSDRKPLRGGGYNPLSGEGGGACSWRPGRRGPSSGG

SEQ ID NO: 118 - DNA, 561 bp, Homosapien
atggaacgccaagaggagtctctgtccgcgcggccggccctggagaccgaggggctgcgcttcctgcacaccacggtgggctccctgctggccacctatggctggtacatcgtcttcagctgcatccttctctacgtggtctttcagaagctttccgcccggctaagagccttgaggcagaggcagctggaccgagctgcggctgctgtggaacctgatgttgttgttaaacgacaagaagctttagcagctgctcgactgaaaatgcaagaagaactaaatgcgcaagttgaaaagcataaggaaaaactgaaacaacttgaagaagaaaaaaggagacagaagattgaaatgtgggacagcatgcaagaaggaaaaagttacaaaggaaatgcaaagaagccccaggaggaagacagtcctgggccttccacttcatctgtcctgaaacggaaatcggacagaaagcctttgcggggaggaggttataacccgttgtctggtgaaggaggcggagcttgctcctggagacctggacgcagaggcccgtcatctggcgga

SEQ ID NO: 119 - protein, 71 aa, Homosapien
MAGMALARAWKQMSWFYYQYLLVTALYMLEPWERTVFNSMLVSIVGMALYTGYVFMPQHIMAILHYFEIVQ

SEQ ID NO: 120 - DNA, 216 bp, Homosapien
atggcggggatggcgctggcgcgggcctggaagcagatgtcctggttctactaccagtacctgctggtcacggcgctctacatgctggagccctgggagcggacggtgttcaattccatgctggtttccattgtggggatggcactatacacaggatacgtcttcatgccccagcacatcatggcgatattgcactactttgaaatcgtacaatga

SEQ ID NO: 121 - protein, 292 aa, Homosapien
MERGPVVGAGLGAGARIQALLGCLLKVLLWVASALLYFGSEQAARLLGSPCLRRLYHAWLAAVVIFGPLLQFHVNPRTIFASHGNFFNIKFVNSAWGWTCTFLGGFVLLVVFLATRRVAVTARHLSRLVVGAAVWRGAGRAFLLIEDLTGSCFEPLPQGLLLHELPDRRSCLAAGHQWRGYTVSSHTFLLTFCCLLMAEEAAVFAKYLAHGLPAGAPLRLVFLLNVLLLGLWNFLLLCTVIYFHQYTHKVVGAAVGTFAWYLTYGSWYHQPWSPGSPGHGLFPRPHSSRKHN

SEQ ID NO: 122 - protein, 96 aa, Homosapien
MAEEAAVFAKYLAHGLPAGAPLRLVFLLNVLLLGLWNFLLLCTVIYFHQYTHKVVGAAVGTFAWYLTYGSWYHQPWSPGSPGHGLFPRPHSSRKHN

SEQ ID NO: 123 - DNA, 879 bp, Homosapien
atggagcgggggccggtggtgggggcaggactgggggccggggcccgaatccaggcactgctgggctgcctgctcaaggtgctgctctgggtggcctctgccttgctgtactttggaagcgaacaggccgcccgccttctgggcagcccctgcttacggcgcctctaccatgcctggctggcagcagtggtcatctttgggccgcttctgcagttccatgtcaaccctcggactatcttcgccagccacggcaacttcttcaacataaaatttgtgaattcagcctggggctggacatgcactttcttagggggctttgtgttgctggtggtgttcctggctacacggcgcgtggcagtaactgccagacacctgagccgactggtagtaggggcagccgtgtggcggggagccggccgggccttcctgctcatcgaggacctgactggctcctgcttcgagccactgccccagggtctgctgctccacgagctgcctgaccgccgcagctgcctggcagccggccaccagtggcgaggctacaccgtctcctcccacaccttcctgctcaccttttgctgcctgctcatggcagaggaagcagctgtgttcgccaagtacctggcccatgggcttcctgccggcgccccactgcgccttgtcttcctgctgaacgtgctgctgctgggcctctggaacttcttgctgctctgtaccgtcatctatttccaccagtacactcacaaggtggtgggcgccgcagtgggcacctttgcctggtacctcacctatggcagctggtatcatcagccctggtctccagggagcccaggccatgggctcttcccccgtccccactccagccgcaagcataactga

SEQ ID NO: 124 - protein, 151 aa, Homosapien
MMAEEHTDLEAQIVKDIHCKEIDLVNRDPKNINEDIVKVDFEDVIAEPVGTYSFDGVWKVSYTTFTVSKYWCYRLLSTLLGVPLALLWGFLFACISFCHIWAVVPCIKSYLIEIQCISHIYSLCIRTFCNPLFAALGQVCSSIKVVLRKEV

SEQ ID NO: 125 - DNA, 456 bp, Homosapien
atgatggcagaagagcacacagatctcgaggcccagatcgtcaaggatatccactgcaaggagattgacctggtgaaccgagaccccaagaacattaacgaggacatagtcaaggtggattttgaagacgtgatcgcagagcctgtgggcacctacagctttgacggcgtgtggaaggtgagctacaccaccttcactgtctccaagtactggtgctaccgtctgttgtccacgctgctgggcgtcccactggccctgctctggggcttcctgttcgcctgcatctccttctgccacatctgggcggtggtgccatgcattaagagctacctgatcgagatccagtgcatcagccacatctactcactctgcatccgcaccttctgcaacccactcttcgcggccctgggccaggtctgcagcagcatcaaggtggtgctgcggaaggaggtctaa

SEQ ID NO: 126 - protein, 222 aa, Homosapien
MALSAETESHIYRALRTASGAAAHLVALGFTIFVAVLARPGSSLFSWHPVLMSLAFSFLMTEALLVFSPESSLLHSLSRKGRARCHWVLQLLALLCALLGLGLVILHKEQLGKAHLVTRHGQAGLLAVLWAGLQCSGGVGLLYPKLLPRWPLAKLKLYHATSGLVGYLLGSASLLLGMCSLWFTASVTGAAWYLAVLCPVLTSLVIMNQVSNAYLYRKRIQP

SEQ ID NO: 127 - DNA, 669 bp, Homosapien
atggccctttctgcggagaccgagtcacacatctaccgagctctgcgtactgcttctggcgctgccgcccaccttgtggccctgggctttaccatctttgtggctgtgcttgccaggcctggctccagcctgttctcctggcacccggtgcttatgtctttggctttctccttcctgatgaccgaggcactactggtgttttctcctgagagttcgctgctgcactccctctcacggaaaggccgagcacgctgccactgggtgctgcagctgctggccctgctgtgtgcactgctgggcctcggccttgtcatcctccacaaagagcagcttggcaaagcccacctggttacgcggcatgggcaggcagggctgctggctgtgctgtgggcagggctgcagtgctcaggtggggtggggctgctctaccccaagctgctgccccgatggcccctggcgaagctcaagctataccatgctacttctgggctggtgggctacctgctgggtagtgccagcctcttgctgggcatgtgctcactctggttcactgcctctgtcactggtgcagcctggtacctggctgtattatgccctgtcctcaccagcttggtcattatgaaccaggtgagcaatgcctacctataccgcaagaggatccaaccatga

SEQ ID NO: 128 - protein, 153 aa, Homosapien; identical to SEQ ID NO: 89

SEQ ID NO: 129 - DNA, 462 bp, Homosapien
atgaatgtgggggtggcacacagcgaagtaaaccccaacacccgagtgatgaatagccgaggcatctggctggcctacatcatcttggtaggattgctgcatatggttctactcagcatccccttcttcagcattcctgttgtctggaccctgaccaacgtcatccataacctggctacgtatgtcttccttcatacggtgaaagggacaccctttgagactcctgaccaaggaaaggctcggctactgacacactgggagcaaatggactatgggctccagtttacctcttcccgcaagttcctcagcatctctcctattgtgctctatctcctggccagcttctataccaagtatgatgctgcgcacttcctcatcaacacagcctcattgctaagtgtactgctgccgaagttgccccagttccatggggttcgtgtctttggcatcaacaaatactga

SEQ ID NO: 130 - protein, 169 aa, Homosapien
MARGGDTGCTGPSETSASGAAAIALPGLEGPATDAQCQTLPLTVLKSRSPSPRSLPPALSCPPPQPAMLEHLSSLPTQMDYKGQKLAEQMFQGIILFSAIVGFIYGYVAEQFGWTVYIVMAGFAFSCLLTLPPWPIYRRHPLKWLPVQESSTDDKKPGERKIKRHAKNN

SEQ ID NO: 131 - DNA, 510 bp, Homosapien
atggcgcggggcggggacacgggctgtaccggcccgtcggagacttccgcttccggggccgccgccatcgctctcccgggcttagaaggcccggctactgacgcgcagtgccagaccttacccctcacggtccttaagtctcggtcgccctcgcctcgcagcctgccacccgcgctcagctgcccgcctcctcagccagccatgctggagcatctgagctcgctgcccacgcagatggattacaagggccagaagctagctgaacagatgtttcagggaattattcttttttctgcaatagttggatttatctacgggtacgtggctgaacagttcgggtggactgtctatatagttatggccggatttgctttttcatgtttgctgacacttcctccatggcccatctatcgccggcatcctctcaagtggttacctgttcaagaatcaagcacagacgacaagaaaccaggggaaagaaaaattaagaggcatgctaaaaataattga

SEQ ID NO: 132 - protein, 58 aa, Homosapien
MNWKVLEHVPLLLYILAAKTLILCLTFAGVKMYQRKRLEAKQQKLEAERKKQSEKKDN

SEQ ID NO: 133 - DNA, 177 bp, Homosapien
atgaattggaaggttcttgagcacgtgcccctgctgctgtatatcttggcagcaaaaacattaattctctgcctgacatttgctggggtgaaaatgtatcaaagaaaaaggttggaggcaaaacaacaaaaactggaggctgaaaggaagaagcaatcagagaaaaaagataactga

SEQ ID NO: 134 - protein, 615 aa, Homosapien
VALPRRYQEGQVSASWGNLIAMVLRSHPFPRQDRPQGSVPRAVPGSPVGPSTSTHSEDRHGPSSSVGTVIGTGTGGLVEAGGQPQPRSSETNGSPSPDPPPGLRGEGTREKSLDPLPQAAMPRGPAQPPAQRPPGPAASSSARRSQPVPQLRKRSRCEIAPSSEQEVRPAASGDPQGEAPGEGGSPAGRSGALTEKQEEARKLMVFLQRPGGWGVVEGPRKPSSRALEPATAAALRRRLDLGSCLDVLAFAQQHGEPGLAQETYALMSDNLLRVLGDPCLYRRLSAADRERILSLRTGRGRAVLGVLVLPSLYQGGRSGLPRGPRGEEPPAAAPVSLPLPAHLHVFNPRENTWRPLTQVPEEAPLRGCGLCTMHNYLFLAGGIRGSGAKAVCSNEVFCYNPLTNIWSQVRPMQQARAQLKLVALDGLLYAIGGECLYSMECYDPRTDAWTPRAPLPAGTFPVAHEAVACRGDIYVTGGHLFYRLLRYSPVKDAWDECPYSASHRRSSDIVALGGFLYRFDLLRGVGAAVMRYNTVTGSWSRAASLPLPAPAPLHCTTLGNTIYCLNPQVTATFTVSGGTAQFQAKELQPFPLGSTGVLSPFILTLPPEDRLQTSL

SEQ ID NO: 135 - DNA, 1845 bp, Homosapien
gtggctctccccaggcgctaccaggaggggcaggtctcagccagctggggaaaccttattgccatggttcttagaagccaccccttccccaggcaagacaggccccaagggagtgtcccgagggcggttcccgggagccccgtgggtcccagcacttccacacactctgaggacagacacggcccctcttcttcagtggggacagtcatagggacaggtacagggggcctggttgaggctggaggtcagccacagccaagaagctccgagaccaacggatcgcccagcccagaccctcccccaggcctaagaggagagggaaccagggagaaaagtctagacccgctgccccaagccgcgatgcccaggggccccgcacagccccccgcgcagaggccgcctggccccgcggcctcctcctctgcgaggcgctcacagccggtaccccagctacggaaacgcagcaggtgcgaaatcgccccgagctcggagcaggaggtcaggccggccgcctcgggggaccctcaaggggaggcgccgggggaggggggcagccctgccggccgcagcggggcgctcacggaaaagcaggaggaggcccggaagctcatggtgtttctgcagaggcccgggggttggggggtggtggaggggccccggaagcccagctcccgggccctggagcccgccacggcggcagccctgcggcggcggctggacctgggcagttgcctggacgtgctggcctttgcccagcagcacggagagcccggcctggcgcaggagacctacgcgctgatgagcgacaacctgctgcgagtgctgggagacccgtgcctctaccgccggctgagcgcggccgaccgcgagcgcatcctcagcctgcggaccggccggggccgggcggtgctgggcgtcctcgtactgcccagcctctaccaggggggccgctcagggctccccaggggccctcgtggcgaggagcctcctgcggcggcccctgtgtccctgcctctacctgcgcacctgcatgtgttcaacccccgggagaacacctggcggcccctgacccaggtgcccgaggaggccccgcttcggggctgcggtctctgcaccatgcacaactacctgtttctggcggggggcatccgtggctccggtgccaaggccgtctgctccaacgaggtcttctgctacaaccctctgaccaacatctggagccaggttcggcccatgcagcaggcccgagcccagctcaagctggtggccctggacgggctgctctatgccatcggtggcgaatgcctgtacagcatggagtgctacgacccgcgaacagacgcctggaccccacgcgcgccactccccgcaggcaccttccctgtggcccacgaggctgtggcctgccgtggggacatctacgtcaccgggggtcacctcttctaccgcctgctcaggtacagccccgtgaaggatgcttgggacgagtgcccatacagtgccagccaccggcgttccagcgacatcgtggcactggggggcttcctgtaccgcttcgacctgctgcggggcgtgggcgccgccgtgatgcgctacaacacagtgaccggctcctggagcagggctgcctccctgcccctgcccgcccccgccccactgcactgcaccaccctgggcaacaccatttactgcctcaacccccaggtcactgccaccttcacggtctctggggggactgcccagttccaggccaaggagctgcagcccttccccttggggagcaccggggtcctcagtccattcatcctgactctgccccctgaggaccggctgcagacctcactc

SEQ ID NO: 136 - protein, 644 aa, Homosapien
MERGLPLLCAVLALVLAPAGAFRNDKCGDTIKIESPGYLTSPGYPHSYHPSEKCEWLIQAPDPYQRIMINFNPHFDLEDRDCKYDYVEVFDGENENGHFRGKFCGKIAPPPVVSSGPFLFIKFVSDYETHGAGFSIRYEIFKRGPECSQNYTTPSGVIKSPGFPEKYPNSLECTYIVFAPKMSEIILEFESFDLEPDSNPPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQVDLGLLRFVTAVGTQGAISKETKKKYYVKTYKIDVSSNGEDWITIKEGNKPVLFQGNTNPTDVVVAVFPKPLITRFVRIKPATWETGISMRFEVYGCKITDYPCSGMLGMVSGLISDSQITSSNQGDRNWMPENIRLVTSRSGWALPPAPHSYINEWLQIDLGEEKIVRGIIIQGGKHRENKVFMRKFKIGYSNNGSDWKMIMDDSKRKAKSFEGNNNYDTPELRTFPALSTRFIRIYPERATHGGLGLRMELLGCEVEAPTAGPTTPNGNLVDECDDDQANCHSGTGDDFQLTGGTTVLATEKPTVIDSTIQSGIK

SEQ ID NO: 137 - DNA, 1935 bp, Homosapien
atggagagggggctgccgctcctctgcgccgtgctcgccctcgtcctcgccccggccggcgcttttcgcaacgataaatgtggcgatactataaaaattgaaagccccgggtaccttacatctcctggttatcctcattcttatcacccaagtgaaaaatgcgaatggctgattcaggctccggacccataccagagaattatgatcaacttcaaccctcacttcgatttggaggacagagactgcaagtatgactacgtggaagtcttcgatggagaaaatgaaaatggacattttaggggaaagttctgtggaaagatagcccctcctcctgttgtgtcttcagggccatttctttttatcaaatttgtctctgactacgaaacacatggtgcaggattttccatacgttatgaaattttcaagagaggtcctgaatgttcccagaactacacaacacctagtggagtgataaagtcccccggattccctgaaaaatatcccaacagccttgaatgcacttatattgtctttgcgccaaagatgtcagagattatcctggaatttgaaagctttgacctggagcctgactcaaatcctccaggggggatgttctgtcgctacgaccggctagaaatctgggatggattccctgatgttggccctcacattgggcgttactgtggacagaaaacaccaggtcgaatccgatcctcatcgggcattctctccatggttttttacaccgacagcgcgatagcaaaagaaggtttctcagcaaactacagtgtcttgcagagcagtgtctcagaagatttcaaatgtatggaagctctgggcatggaatcaggagaaattcattctgaccagatcacagcttcttcccagtatagcaccaactggtctgcagagcgctcccgcctgaactaccctgagaatgggtggactcccggagaggattcctaccgagagtggatacaggtagacttgggccttctgcgctttgtcacggctgtcgggacacagggcgccatttcaaaagaaaccaagaagaaatattatgtcaagacttacaagatcgacgttagctccaacggggaagactggatcaccataaaagaaggaaacaaacctgttctctttcagggaaacaccaaccccacagatgttgtggttgcagtattccccaaaccactgataactcgatttgtccgaatcaagcctgcaacttgggaaactggcatatctatgagatttgaagtatacggttgcaagataacagattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaagtcttttgagggcaacaacaactatgatacacctgagctgcggacttttccagctctctccacgcgattcatcaggatctaccccgagagagccactcatggcggactggggctcagaatggagctgctgggctgtgaagtggaagcccctacagctggaccgaccactcccaacgggaacttggtggatgaatgtgatgacgaccaggccaactgccacagtggaacaggtgatgacttccagctcacaggtggcaccactgtgctggccacagaaaagcccacggtcatagacagcaccatacaatcaggtatcaaataa

SEQ ID NO: 138 - protein, 926 aa, Homosapien
MDMFPLTWVFLALYFSRHQVRGQPDPPCGGRLNSKDAGYITSPGYPQDYPSHQNCEWIVYAPEPNQKIVLNFNPHFEIEKHDCKYDFIEIRDGDSESADLLGKHCGNIAPPTIISSGSMLYIKFTSDYARQGAGFSLRYEIFKTGSEDCSKNFTSPNGTIESPGFPEKYPHNLDCTFTILAKPKMEIILQFLIFDLEHDPLQVGEGDCKYDWLDIWDGIPHVGPLIGKYCGTKTPSELRSSTGILSLTFHTDMAVAKDGFSARYYLVHQEPLENFQCNVPLGMESGRIANEQISASSTYSDGRWTPQQSRLHGDDNGWTPNLDSNKEYLQVDLRFLTMLTAIATQGAISRETQNGYYVKSYKLEVSTNGEDWMVYRHGKNHKVFQANNDATEVVLNKLHAPLLTRFVRIRPQTWHSGIALRLELFGCRVTDAPCSNMLGMLSGLIADSQISASSTQEYLWSPSAARLVSSRSGWFPRIPQAQPGEEWLQVDLGTPKTVKGVIIQGARGGDSITAVEARAFVRKFKVSYSLNGKDWEYIQDPRTQQPKLFEGNMHYDTPDIRRFDPIPAQYVRVYPERWSPAGIGMRLEVLGCDWTDSKPTVETLGPTVKSEETTTPYPTEEEATECGENCSFEDDKDLQLPSGFNCNFDFLEEPCGWMYDHAKWLRTTWASSSSPNDRTFPDDRNFLRLQSDSQREGQYARLISPPVHLPRSPVCMEFQYQATGGRGVALQVVREASQESKLLWVIREDQGGEWKHGRIILPSYDMEYQIVFEGVIGKGRSGEIAIDDIRISTDVPLENCMEPISAFAVDIPEIHEREGYEDEIDDEYEVDWSNSSSATSGSGAPSTDKEKSWLYTLDPILITIIAMSSLGVLLGATCAGLLLYCTCSYSGLSSRSCTTLENYNFELYDGLKHKVKMNHQKCCSEA

SEQ ID NO: 139 - DNA, 2781 bp, Homosapien
atggatatgtttcctctcacctgggttttcttagccctctacttttcaagacaccaagtgagaggccaaccagacccaccgtgcggaggtcgtttgaattccaaagatgctggctatatcacctctcccggttacccccaggactacccctcccaccagaactgcgagtggattgtttacgcccccgaacccaaccagaagattgtcctcaacttcaaccctcactttgaaatcgagaagcacgactgcaagtatgactttatcgagattcgggatggggacagtgaatccgcagacctcctgggcaaacactgtgggaacatcgccccgcccaccatcatctcctcgggctccatgctctacatcaagttcacctccgactacgcccggcagggggcaggcttctctctgcgctacgagatcttcaagacaggctctgaagattgctcaaaaaacttcacaagccccaacgggaccatcgaatctcctgggtttcctgagaagtatccacacaacttggactgcacctttaccatcctggccaaacccaagatggagatcatcctgcagttcctgatctttgacctggagcatgaccctttgcaggtgggagagggggactgcaagtacgattggctggacatctgggatggcattccacatgttggccccctgattggcaagtactgtgggaccaaaacaccctctgaacttcgttcatcgacggggatcctctccctgacctttcacacggacatggcggtggccaaggatggcttctctgcgcgttactacctggtccaccaagagccactagagaactttcagtgcaatgttcctctgggcatggagtctggccggattgctaatgaacagatcagtgcctcatctacctactctgatgggaggtggacccctcaacaaagccggctccatggtgatgacaatggctggacccccaacttggattccaacaaggagtatctccaggtggacctgcgctttttaaccatgctcacggccatcgcaacacagggagcgatttccagggaaacacagaatggctactatgtcaaatcctacaagctggaagtcagcactaatggagaggactggatggtgtaccggcatggcaaaaaccacaaggtatttcaagccaacaacgatgcaactgaggtggttctgaacaagctccacgctccactgctgacaaggtttgttagaatccgccctcagacctggcactcaggtatcgccctccggctggagctcttcggctgccgggtcacagatgctccctgctccaacatgctggggatgctctcaggcctcattgcagactcccagatctccgcctcttccacccaggaatacctctggagccccagtgcagcccgcctggtcagcagccgctcgggctggttccctcgaatccctcaggcccagcccggtgaggagtggcttcaggtagatctgggaacacccaagacagtgaaaggtgtcatcatccagggagcccgcggaggagacagtatcactgctgtggaagccagagcatttgtgcgcaagttcaaagtctcctacagcctaaacggcaaggactgggaatacattcaggaccccaggacccagcagccaaagctgttcgaagggaacatgcactatgacacccctgacatccgaaggtttgaccccattccggcacagtatgtgcgggtatacccggagaggtggtcgccggcggggattgggatgcggctggaggtgctgggctgtgactggacagactccaagcccacggtagagacgctgggacccactgtgaagagcgaagagacaaccaccccctaccccaccgaagaggaggccacagagtgtggggagaactgcagctttgaggatgacaaagatttgcagctcccttcgggattcaattgcaacttcgatttcctcgaggagccctgtggttggatgtatgaccatgccaagtggctccggaccacctgggccagcagctccagcccaaacgaccggacgtttccagatgacaggaatttcttgcggctgcagagtgacagccagagagagggccagtatgcccggctcatcagcccccctgtccacctgccccgaagcccggtgtgcatggagttccagtaccaggccacgggcggccgcggggtggcgctgcaggtggtgcgggaagccagccaggagagcaagttgctgtgggtcatccgtgaggaccagggcggcgagtggaagcacgggcggatcatcctgcccagctacgacatggagtaccagattgtgttcgagggagtgatagggaaaggacgttccggagagattgccattgatgacattcggataagcactgatgtcccactggagaactgcatggaacccatctcggcttttgcagtggacatcccagaaatacatgagagagaaggatatgaagatgaaattgatgatgaatacgaggtggactggagcaattcttcttctgcaacctcagggtctggcgccccctcgaccgacaaagaaaagagctggctgtacaccctggatcccatcctcatcaccatcatcgccatgagctcactgggcgtcctcctgggggccacctgtgcaggcctcctgctctactgcacctgttcctactcgggcctgagctcccgaagctgcaccacactggagaactacaacttcgagctctacgatggccttaagcacaaggtcaagatgaaccaccaaaagtgctgctccgaggcatga

SEQ ID NO: 140 - protein, 449 aa, Homosapien
MWTALVLIWIFSLSLSESHAASNDPRNFVPNKMWKGLVKRNASVETVDNKTSEDVTMAAASPVTLTKGTSAAHLNSMEVTTEDTSRTDVSEPATSGGAADGVTSIAPTAVASSTTAASITTAASSMTVASSAPTTAASSTTVASIAPTTAASSMTAASSTPMTLALPAPTSTSTGRTPSTTATGHPSLSTALAQVPKSSALPRTATLATLATRAQTVATTANTSSPMSTRPSPSKHMPSDTAASPVPPMRPQAQGPISQVSVDQPVVNTTNKSTPMPSNTTPEPAPTPTVVTTTKAQAREPTASPVPVPHTSPIPEMEAMSPTTQPSPMPYTQRAAGPGTSQAPEQVETEATPGTDSTGPTPRSSGGTKMPATDSCQPSTQGQYMVVTTEPLTQAVVDKTLLLVVLLLGVTLFITVLVLFALQAYESYKKKDYTQVDYLINGMYADSEM

SEQ ID NO: 141 - DNA, 1350 bp, Homosapien
atgtggacagctcttgtgctcatttggattttctccttgtccttatctgaaagccatgcggcatccaacgatccacgcaactttgtccctaacaaaatgtggaagggattagtcaagaggaatgcatctgtggaaacagttgataataaaacgtctgaggatgtaaccatggcagcagcttctcctgtcacattgaccaaagggacttcggcagcccacctcaactctatggaagtcacaacagaggacacaagcaggacagatgtgagtgaaccagcaacttcaggaggtgcagctgatggtgtgacctccattgctcccacggctgtggcctccagtacgactgcggcctccattacgactgcggcctccagtatgactgtggcctccagtgctcccacgactgcagcctccagtacaactgtggcctccattgctcccacgactgcagcctccagtatgactgcggcctccagcactcccatgacacttgcactccccgcgcccacgtccacttccacagggcggaccccgtccactaccgccactgggcatccatctctcagcacagccctcgcacaagtgccaaagagcagcgcgttgccaagaacagcaaccctggccacattggccacacgtgctcagactgtagcgaccacagcaaacacaagcagccccatgagcactcgtccaagtccttccaagcacatgcccagtgacaccgcggcaagccctgtaccccctatgcgtccccaagcacaaggtcccattagccaggtgtcagtggaccagcctgtggttaacacaacaaataaatccacacccatgccctcaaacacaaccccagagcccgcccccacccccacagtggtgaccaccaccaaggcacaagccagggagccaactgccagcccagtgccagtacctcacaccagcccaatccctgagatggaggccatgtcccccacgacacagccaagccccatgccatatacccagagggccgctgggccaggcacatcccaggcaccggagcaggtagagactgaagccacaccaggtactgattccactgggccaacacccaggagctcagggggcactaagatgccagccacggactcgtgccagcccagcacccaaggccagtacatggtggtcaccactgagcccctcacccaggccgtggtagacaaaactctccttctggtggtgctgttactcggggtgacccttttcatcacagtcttggttttgtttgccctgcaggcctatgagagctacaagaagaaggactacacccaggtggactacttaatcaacgggatgtatgcggactcagaaatgtga

SEQ ID NO: 142 - protein, 199 aa, Homosapien
MLLELSEEHKEHLAFLPQVDSAVVAEFGRIAVEFLRRGANPKIYEGAARKLNVSSDTVQHGVEGLTYLLTESSKLMISELDFQDSVFVLGFSEELNKLLLQLYLDNRKEIRTILSELAPSLPSYHNLEWRLDVQLASRSLRQQIKPAVTIKLHLNQNGDHNTKVLQTDPATLLHLVQQLEQALEEMKTNHCRRVVRNIK

SEQ ID NO: 143 - DNA, 600 bp, Homosapien
atgctgctggaattgtccgaggagcataaggaacacctggccttcctgcctcaagtggacagcgcggtggtcgccgagtttgggcggattgctgtggaattcctgagacgcggcgcaaacccaaaaatctacgaaggcgccgccagaaaactcaatgtgagtagtgacactgtccagcatggtgtggaaggattaacgtatctcctcactgagagctcaaagctcatgatttctgaactggatttccaagactctgtttttgttctgggattctctgaagaattaaacaaattgttgcttcagctttatctggacaacagaaaagagatcagaacgattctgagtgaattggcaccaagccttcccagttatcataaccttgaatggcgactagatgtacagcttgcaagtagaagtctcaggcaacagattaaaccagcagtgactataaagctacaccttaatcaaaatggagatcacaacaccaaagttctgcagacagacccagccaccctgctccatttggttcaacaactggaacaagcattggaagagatgaagacaaatcactgtaggagagttgttcgcaacatcaagtag

SEQ ID NO: 144 - protein, 509 aa, Homosapien
MQSWSRVYCSLAKRGHFNRISHGLQGLSAVPLRTYADQPIDADVTVIGSGPGGYVAAIKAAQLGFKTVCIEKNETLGGTCLNVGCIPSKALLNNSHYYHMAHGKDFASRGIEMSEVRLNLDKMMEQKSTAVKALTGGIAHLFKQNKVVHVNGYGKITGKNQVTATKADGGTQVIDTKNILIATGSEVTPFPGITIDEDTIVSSTGALSLKKVPEKMVVIGAGVIGVELGSVWQRLGADVTAVEFLGHVGGVGIDMEISKNFQRILQKQGFKFKLNTKVTGATKKSDGKIDVSIEAASGGKAEVITCDVLLVCIGRRPFTKNLGLEELGIELDPRGRIPVNTRFQTKIPNIYAIGDVVAGPMLAHKAEDEGIICVEGMAGGAVHIDYNCVPSVIYTHPEVAWVGKSEEQLKEEGIEYKVGKFPFAANSRAKTNADTDGMVKILGQKSTDRVLGAHILGPGAGEMVNEAALALEYGASCEDIARVCHAHPTLSEAFREANLAASFGKSINF

SEQ ID NO: 145 - DNA, 1530 bp, Homosapien
atgcagagctggagtcgtgtgtactgctccttggccaagagaggccatttcaatcgaatatctcatggcctacagggactttctgcagtgcctctgagaacttacgcagatcagccgattgatgctgatgtaacagttataggttctggtcctggaggatatgttgctgctattaaagctgcccagttaggcttcaagacagtctgcattgagaaaaatgaaacacttggtggaacatgcttgaatgttggttgtattccttctaaggctttattgaacaactctcattattaccatatggcccatggaaaagattttgcatctagaggaattgaaatgtccgaagttcgcttgaatttagacaagatgatggagcagaagagtactgcagtaaaagctttaacaggtggaattgcccacttattcaaacagaataaggttgttcatgtcaatggatatggaaagataactggcaaaaatcaagtcactgctacgaaagctgatggcggcactcaggttattgatacaaagaacattcttatagccacgggttcagaagttactccttttcctggaatcacgatagatgaagatacaatagtgtcatctacaggtgctttatctttaaaaaaagttccagaaaagatggttgttattggtgcaggagtaataggtgtagaattgggttcagtttggcaaagacttggtgcagatgtgacagcagttgaatttttaggtcatgtaggtggagttggaattgatatggagatatctaaaaactttcaacgcatccttcaaaaacaggggtttaaatttaaattgaatacaaaggttactggtgctaccaagaagtcagatggaaaaattgatgtttctattgaagctgcttctggtggtaaagctgaagttatcacttgtgatgtactcttggtttgcattggccgacgaccctttactaagaatttgggactagaagagctgggaattgaactagatcccagaggtagaattccagtcaataccagatttcaaactaaaattccaaatatctatgccattggtgatgtagttgctggtccaatgctggctcacaaagcagaggatgaaggcattatctgtgttgaaggaatggctggtggtgctgtgcacattgactacaattgtgtgccatcagtgatttacacacaccctgaagttgcttgggttggcaaatcagaagagcagttgaaagaagagggtattgagtacaaagttgggaaattcccatttgctgctaacagcagagctaagacaaatgctgacacagatggcatggtgaagatccttgggcagaaatcgacagacagagtactgggagcacatattcttggaccaggtgctggagaaatggtaaatgaagctgctcttgctttggaatatggagcatcctgtgaagatatagctagagtctgtcatgcacatccgaccttatcagaagcttttagagaagcaaatcttgctgcgtcatttggcaaatcaatcaacttttga

SEQ ID NO: 146 - protein, 1048 aa, Homosapien
MACIHYLRENREKFEAFIEGSFEEYLKRLENPQEWVGQVEISALSLMYRKDFIIYREPNVSPSQVTENNFPEKVLLCFSNGNHYDIVYPIKYKESSAMCQSLLYELLYEKVFKTDVSKIVMELDTLEVADEDNSEISDSEDDSCKSKTAAAAADVNGFKPLSGNELKNNGNSTSLPLSRKVLKSLNPAVYRNVEYEIWLKSKQAQQKRDYSIAAGLQYEVGDKCQVRLDHNGKFLNADVQGIHSENGPVLVEELGKKHTSKNLKAPPPESWNTVSGKKMKKPSTSGQNFHSDVDYRGPKNPSKPIKAPSALPPRLQHPSGVRQHAFSSHSSGSQSQKFSSEHKNLSRTPSQIIRKPDRERVEDFDHTSRESNYFGLSPEERREKQAIEESRLLYEIQNRDEQAFPALSSSSVNQSASQSSNPCVQRKSSHVGDRKGSRRRMDTEERKDKDSIHGHSQLDKRPEPSTLENITDDKYATVSSPSKSKKLECPSPAEQKPAEHVSLSNPAPLLVSPEVHLTPAVPSLPATVPAWPSEPTTFGPTGVPAPIPVLSVTQTLTTGPDSAVSQAHLTPSPVPVSIQAVNQPLMPLPQTLSLYQDPLYPGFPCNEKGDRAIVPPYSLCQTGEDLPKDKNILRFFFNLGVKAYSCPMWAPHSYLYPLHQAYLAACRMYPKVPVPVYPHNPWFQEAPAAQNESDCTCTDAHFPMQTEASVNGQMPQPEIGPPTFSSPLVIPPSQVSESHGQLSYQADLESETPGQLLHADYEESLSGKNMFPQPSFGPNPFLGPVPIAPPFFPHVWYGYPFQGFIENPVMRQNIVLPSDEKGELDLSLENLDLSKDCGSVSTVDEFPEARGEHVHSLPEASVSSKPDEGRTEQSSQTRKADTALASIPPVAEGKAHPPTQILNRERETVPVELEPKRTIQSLKEKTEKVKDPKTAADVVSPGANSVDSRVQRPKEESSEDENEVSNILRSGRSKQFYNQTYGSRKYKSDWGYSGRGGYQHVRSEESWKGQPSRSRDEGYQYHRNVRGRPFRGDRRRSGMGDGHRGQHT

SEQ ID NO: 147 - DNA, 3147 bp, Homosapien
atggcctgtattcactatcttcgagagaacagagagaaatttgaagcgtttatagaaggatcatttgaagaatatttaaagcgtttggaaaatccacaggaatgggtaggacaagtggaaataagtgccctttctcttatgtacaggaaagattttataatttatcgggaaccaaatgtttctccttcacaagtaacagaaaataattttcctgaaaaggtgttactgtgtttttcaaatggaaatcattatgatattgtgtatcccataaagtataaagaaagctctgctatgtgtcagtctctcctttatgaattgctgtatgagaaggtatttaaaactgatgttagtaaaattgtgatggaactagacacgttggaagtagctgatgaagataacagtgaaatatcagattcagaggatgacagttgcaagagtaagactgctgctgctgctgctgatgtgaatggatttaaacctttgtcaggcaatgagctgaagaacaatgggaactctactagcctgcctttgtctagaaaggttcttaagtcactcaatcctgcagtctatagaaatgtggaatatgaaatttggctgaagtctaaacaagctcagcaaaaacgtgattattccattgctgctggcttacaatatgaagttggagacaaatgtcaagttaggttggatcacaatggaaaatttttgaatgcagatgttcaaggaattcattctgagaatggaccagttttggttgaagaactgggaaagaagcacacatcaaagaacctcaaggcacctcccccagaaagctggaacacagtgtcagggaagaagatgaaaaaaccttccacttctggacaaaatttccattctgatgtggattacagagggccaaagaatccaagcaagccaataaaagccccatcagcactacctcctcgactgcagcatccttcaggagtaagacaacatgcgttctctagtcattcttcagggtcacagtctcagaaattctccagtgagcacaaaaatcttagccggacaccttcacagatcataagaaaacctgatcgtgaaagagttgaggattttgatcacacaagtcgagaatctaactatttcggcctttccccagaagagcgcagagagaagcaagctatagaagaatcccgtttactctatgagattcagaacagagatgaacaggctttcccagccctttccagctcatcagtcaatcagtcagcttctcagagtagcaatccatgtgtccagagaaaatcatcacatgtaggtgatagaaaaggaagcaggcggagaatggatacagaagaacgaaaagacaaagactctattcatggacatagtcagttggataaaagacccgaaccaagcacattggagaatattactgatgataaatatgcaacagtttcatcaccatcaaagtcaaagaagttagagtgcccttctcctgcggaacaaaagccagcagaacatgtgtctttgtcaaatccagctccccttctagtttctccagaggtacatctaactcctgcggtgccttctttaccagccactgtgccagcctggccaagtgaacctacaacttttggaccaacaggtgtccctgctccaattcccgttttgtcagtgacacagactttgaccactggacctgattcagctgtatcccaagctcatttaacaccctctccagttcctgtgtcaatacaggcagttaaccagcccttgatgcctttgcctcagacattgagcctttatcaagacccactctatcctgggtttccttgtaatgaaaagggagatcgagccattgtaccaccttattcactgtgtcagactggggaggacctacctaaagataagaatattcttcgattcttcttcaatcttggtgtgaaggcatacagttgtcctatgtgggccccacattcttacctgtaccctctgcaccaggcctacctggcagcctgcaggatgtacccaaaggtccctgtccctgtttatcctcataatccctggttccaagaggctcctgctgctcagaatgaaagtgattgtacctgtactgatgcccactttcctatgcagactgaggccagtgttaatggtcaaatgccacagccagagattggaccgccgacattttcttcacctctggttatccctccatctcaggtgtctgaaagtcatggacaattgtcttaccaggctgatcttgaatctgagacccctgggcagcttctgcatgctgattatgaagagtcactaagtggcaagaatatgttcccccagccatcttttggacccaatccattcttaggcccagttcctattgcacctcctttctttcctcatgtttggtatgggtacccttttcagggattcatagaaaatccagtaatgaggcagaatattgtcctgccctctgatgaaaaaggagaattggatctgtctctggaaaatctggatctgtctaaagattgtggttcagtttcaacagtagatgagtttccagaagccaggggtgaacatgtacattctctccctgaagcaagtgtgagcagtaagccggacgaaggccggacagagcaatcttcccagacacgaaaggcagatacggcattggcttccatccctcctgtagcagagggaaaggctcatcctcccactcagattctaaacagagagagagaaactgtgcctgttgaacttgaacctaaaaggaccattcaaagcctgaaagaaaaaacagaaaaagtaaaagatcctaagactgctgctgatgtggtcagccctggggccaactctgttgatagcagagtgcaaagaccaaaagaagagagttcagaagatgaaaatgaagtgtctaatattttgagaagtggtagatccaagcagttctataatcaaacttatggaagcaggaagtacaaaagtgattggggctattctggtaggggtggatatcaacatgtgagaagtgaggagtcctggaaaggacagccaagcagaagtcgggatgaaggttatcagtaccatcgaaatgtcagagggcgaccatttaggggagataggaggagatcagggatgggagatggccataggggacagcacacttga

SEQ ID NO: 148 - protein, 271 aa, Homosapien
MTRWARVSTTYNKRPLPATSWEDMKKGSFEGTSQNLPKRKQLEANRLSLKNDAPQAKHKKNKKKKEYLNEDVNGFMEYLRQNSQMVHNGQIIATDSEEVREEIAVALKKDSRREGRRLKRQAAKKNAMVCFHCRKPGHGIADCPAALENQDMGTGICYRCGSTEHEITKCKAKVDPALGEFPFAKCFVCGEMGHLSRSCPDNPKGLYADGGGCKLCGSVEHLKKDCPESQNSERMVTVGRWAKGMSADYEEILDVPKPQKPKTKIPKVVNF

SEQ ID NO: 149 - DNA, 816 bp, Homosapien
atgaccaggtgggcccgagttagtaccacatataacaagagacccttgcctgcaacatcatgggaggacatgaagaagggatcctttgagggaacaagccaaaacctaccaaagcgtaaacaacttgaagccaataggctatccctcaaaaatgatgcaccccaagcaaaacataaaaagaacaaaaagaaaaaagagtacttaaatgaagatgtgaatggattcatggaatacctaagacagaattcacagatggttcacaatgggcaaattatagcaacagacagtgaggaagtaagggaagaaattgcagttgctttaaagaaagacagtcgacgggaaggaagaagattaaaaagacaagcggcaaagaaaaatgcaatggtgtgtttccattgtagaaaacctggtcatggaattgcagattgccccgccgcccttgaaaatcaagacatgggcactgggatatgttacaggtgtgggtccacagagcacgaaataaccaagtgtaaggctaaagtagacccggctcttggcgaatttccttttgcaaaatgttttgtttgtggagaaatggggcacctgtctagatcttgtcctgataatcccaaaggactctatgctgatggtggcggttgcaaactttgtggctctgtggaacatttaaagaaagattgccctgaaagtcagaattcagagcgaatggtcacagttggtcgctgggcaaagggaatgagtgcagactatgaagaaattttggatgtacctaaaccgcaaaaacccaaaacaaaaatacctaaagttgttaatttttga

SEQ ID NO: 150 - protein, 321 aa, Homosapien
MAAAEAGGDDARCVRLSAERAQALLADVDTLLFDCDGVLWRGETAVPGAPEALRALRARGKRLGFITNNSSKTRAAYAEKLRRLGFGGPAGPGASLEVFGTAYCTALYLRQRLAGAPAPKAYVLGSPALAAELEAVGVASVGVGPEPLQGEGPGDWLHAPLEPDVRAVVVGFDPHFSYMKLTKALRYLQQPGCLLVGTNMDNRLPLENGRFIAGTGCLVRAVEMAAQRQADIIGKPSRFIFDCVSQEYGINPERTVMVGDRLDTDILLGATCGLKTILTLTGVSTLGDVKNNQESDCVSKKKMVPDFYVDSIADLLPALQG

SEQ ID NO: 151 - DNA, 966 bp, Homosapien
atggcggcggcggaggccggtggcgacgacgcccgctgcgtgcggctgagcgccgagcgggcacaggcgctgctggccgacgtggacacgctgctgttcgactgcgacggcgtgctgtggcgcggggagaccgccgtgcctggcgcgcccgaggccctgcgggcgctgcgagcccgcggcaagcgcctgggcttcatcaccaacaacagcagcaagacccgcgctgcctacgccgagaagctgcggcgcctgggcttcggcggccccgcggggcccggcgccagcctggaggtcttcggcacggcctactgcaccgcgctctacctgcgccagcgcctggccggcgcccccgcgcccaaggcctacgtgctgggcagcccagccctggccgcggagctggaggccgtgggcgtcgccagcgtgggcgtggggcccgagccactgcagggcgagggtcccggcgactggctgcacgcgccgctggagcccgacgtgcgcgcggtggtggtgggctttgacccgcacttcagctacatgaagctcaccaaggccctgcgctacctgcagcagcccggctgcctgctcgtgggcaccaacatggacaaccggcttccgcttgagaacggccgcttcatcgcgggtaccgggtgtctggtccgagccgtggagatggccgcccagcgccaggccgacatcatcgggaagcccagccgcttcattttcgactgcgtgtcccaggaatacggcatcaaccccgagcgcaccgtcatggtgggagaccgcctggacacagacatcctcctaggcgccacctgtggcctgaagaccatcctgaccctcaccggagtctccactctaggggatgtgaagaataatcaggaaagtgactgcgtgtctaagaagaaaatggtccctgacttctatgttgacagcatagccgaccttttgcctgcccttcaaggttaa

SEQ ID NO: 152 - DNA, 2027 bp, Homosapien
tgtggctgcagagcctgctgctcttgggcactgtggcctgcagcatctctgcacccgcccgctcgcccagccccagcacgcagccctgggagcatgtgaatgccatccaggaggcccggcgtctcctgaacctgagtagagacactgctgctgagatggtaagtgagagaatgtgggcctgtgcctaggccacccagctggcccctgactggccacgcctgtcagcttgataacatgacattttccttttctacagaatgaaacagtagaagtcatctcagaaatgtttgacctccaggtaagatgcttctctctgacatagctttccagaagcccctgccctggggtggaggtggggactccattttagatggcaccacacagggttgtccactttctctccagtcagctggctgcaggaggagggggtagcaactgggtgctcaagaggctgctggccgtgcccctatggcagtcacatgagctcctttatcagctgagcggccatgggcagacctagcattcaatggccaggagtcaccaggggacaggtggtaaagtgggggtcacttcatgagacaggagctgtgggtttggggcgctcactgtgccccgagaccaagtcctgttgagacagtgctgactacagagaggcacagaggggtttcaggaacaacccttgcccacccagcaggtccaggtgaggccccacccccctctccctgaatgatggggtgagagtcacctccttccctaaggctgggctcctctccaggtgccgctgagggtggcctgggcggggcagtgagaagggcaggttcgtgcctgccatggacagggcagggtctatgactggacccagcctgtgcccctcccaagccctactcctgggggctgggggcagcagcaaaaaggagtggtggagagttcttgtaccactgtgggcacttggccactgctcaccgacgaacgacattttccacaggagccgacctgcctacagacccgcctggagctgtacaagcagggcctgcggggcagcctcaccaagctcaagggccccttgaccatgatggccagccactacaagcagcactgccctccaaccccggtgagtgcctacggcagggcctccagcaggaatgtcttaatctagggggtggggtcgacatggggagagatctatggctgtggctgttcaggaccccagggggtttctgtgccaacagttatgtaatgattagccctccagagaggaggcagacagcccatttcatcccaaggagtcagagccacagagcgctgaagcccacagtgctccccagcaggagctgctcctatcctggtcattattgtcattatggttaatgaggtcagaggtgagggcaaacccaaggaaacttggggcctgcccaaggcccagaggaagtgcccaggcccaagtgccaccttctggcaggactttcctctggccccacatggggtgcttgaattgcagaggatcaaggaaggggggctacttggaatggacaaggacctcaggcactccttcctgcgggaagggagcaaagtttgtggccttgactccactccttctgggtgcccagagacgacctcagcccagctgccctgctctgccctgggaccaaaaaggcaggcgtttgactgcccagaaggccaacctcaggctggcacttaagtcaggcccttgactctggctgccactggcagagctatgcactccttggggaacacgtgggtggcagcagcgtcacctgacccaggtcagtgggtgtgtcctggagtgggcctcctggcctctgagttctaagaggcagtagagaaacatgctggtgcttccttcccccacgttacccacttgcctggactcaagtgttttttatttttctttttttaaaggaaacttcctgtgcaacccagattatcacctttgaaagtttcaaagagaacctgaaggactttctgcttgtcatcccctttgactgctgggagccagtccaggagtg

SEQ ID NO: 153 - DNA, 435 bp, Homosapien
atgtggctgcagagcctgctgctcttgggcactgtggcctgcagcatctctgcacccgcccgctcgcccagccccagcacgcagccctgggagcatgtgaatgccatccaggaggcccggcgtctcctgaacctgagtagagacactgctgctgagatgaatgaaacagtagaagtcatctcagaaatgtttgacctccaggagccgacctgcctacagacccgcctggagctgtacaagcagggcctgcggggcagcctcaccaagctcaagggccccttgaccatgatggccagccactacaagcagcactgccctccaaccccggaaacttcctgtgcaacccagactatcacctttgaaagtttcaaagagaacctgaaggactttctgcttgtcatcccctttgactgctgggagccagtccaggagtaa

SEQ ID NO: 154 - protein, 144 aa, Homosapien [sequence omitted]

SEQ ID NO: 155 - protein, 375 aa, Homosapien
MAVMAPRTLVLLLSGALALTQTWAGSHSMRYFSTSVSRPGRGEPRFIAVGYVDDTQFVRFDSDAASQRMEPRAPWIEQEGPEYWDEETGKVKAHSQTDRENLRIALRYYNQSEAGSHTLQMMFGCDVGSDGRFLRGYHQYAYDGKDYIALKEDLRSWTAADMAAQITKRKWEAAHVAEQQRAYLEGTCVDGLRRYLENGKETLQRTDPPKTHMTHHPISDHEATLRCWALGFYPAEITLTWQRDGEDQTQDTELVETRPAGDGTFQKWAAVVVPSGEEQRYTCHVQHEGLPKPLTLRWEPSSQPTVPIVGIIAGLVLLGAVITGAVVAAVMWRRNSSDRKGGSYSQAASSDSAQGSDVSLTACKVSGDYKDDDDK

SEQ ID NO: 156 - DNA, 1128 bp, Homosapien
atggccgtcatggcgccccgaaccctcgtcctgctactctcgggggccctggccctgacccagacctgggcaggctcccactccatgaggtatttctccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacgaggagacagggaaagtgaaggcccactcacagactgaccgagagaacctgcggatcgcgctccgctactacaaccagagcgaggccggttctcacaccctccagatgatgtttggctgcgacgtggggtcggacgggcgcttcctccgcgggtaccaccagtacgcctacgacggcaaggattacatcgccctgaaagaggacctgcgctcttggaccgcggcggacatggcggctcagatcaccaagcgcaagtgggaggcggcccatgtggcggagcagcagagagcctacctggagggcacgtgcgtggacgggctccgcagatacctggagaacgggaaggagacgctgcagcgcacggacccccccaagacacatatgacccaccaccccatctctgaccatgaggccactctgagatgctgggccctgggcttctaccctgcggagatcacactgacctggcagcgggatggggaggaccagacccaggacacggagcttgtggagaccaggcctgcaggggatggaaccttccagaagtgggcagctgtggtggtaccttctggagaggagcagagatacacctgccatgtgcagcatgagggtctgcccaagcccctcaccctgagatgggagccatcttcccagcccaccgtccccatcgtgggcatcattgctggcctggttctccttggagctgtgatcactggagctgtggtcgctgctgtgatgtggaggaggaacagctcagatagaaaaggagggagctactctcaggctgcaagcagtgacagtgcccagggctctgatgtgtctctcacagcttgtaaagtgtccggagattacaaggatgacgacgataagtag

SEQ ID NO: 157 - protein, 148 aa, Homosapien
MAELQQLRVQEAVESMVKSLERENIRKMQGLMFRCSASCCEDSQASMKQVHQCIERCHVPLAQAQALVTSELEKFQDRLARCTMHCNDKAKDSIDAGSKELQVKQQLDSCVTKCVDDHMHLIPTMTKKMKEALLSIGKSGDYKDDDDK

SEQ ID NO: 158 - DNA, 447 bp, Homosapien
atggctgagctgcagcagctccgggtgcaggaggcggtggagtccatggtgaagagtctggaaagagagaacatacggaagatgcagggtctcatgttccggtgcagcgccagctgttgtgaggacagccaggcctccatgaagcaggtgcaccagtgcatcgagcgctgccatgtgcctctggctcaagcccaggctttggtcaccagtgagctggagaagttccaggaccgcctggcccggtgcaccatgcattgcaacgacaaagccaaagattcaatagatgctgggagtaaggagcttcaggtgaagcagcagctggacagttgtgtgaccaagtgtgtggatgaccacatgcacctcatcccaactatgaccaagaagatgaaggaggctctcttatcaattggaaaatccggagattacaaggatgacgacgataagtag

SEQ ID NO: 159 - protein, 64 aa, Homosapien
MAAVAAASAELLIIGWYIFRVLLQVFRYSLQKLAYTVSRTGRQVLGERRQRAPNSGDYKDDDDK

SEQ ID NO: 160 - DNA, 195 bp, Homosapien
atggcggcagtggcggcggcctcggctgaactgctcatcatcggctggtacatcttccgcgtgctgctgcaggtgttcaggtactccctgcagaagctggcatacacggtgtcgcggaccgggcggcaggtgttgggggagcgcaggcagcgagcccccaactccggagattacaaggatgacgacgataagtag

SEQ ID NO: 161 - DNA, 20 bp, Homosapien
actacctgatcagtgtcaaa

SEQ ID NO: 162 - DNA, 32 bp, Homosapien
gtaatctccggaaggcactgtgacatgaaaag

SEQ ID NO: 163 - DNA, 20 bp, Homosapien
gcctacccacaggagattcc

SEQ ID NO: 164 - DNA, 32 bp, Homosapien
gtaatctccggaaggtgcaagtctctcataga

SEQ ID NO: 165 - DNA, 39 bp, Homosapien
gggcccgaattcatggcggcggagcgacaggaggcgctg

SEQ ID NO: 166 - DNA, 32 bp, Homosapien
gtaatctccggatgttaaccgctgcacgatga

SEQ ID NO: 167 - DNA, 30 bp, Homosapien
atatggatccatggccgtcatggcgccccg

SEQ ID NO: 168 - DNA, 30 bp, Homosapien
aatctccggacactttacaagctgtgagag

What is claimed is:

1. A method for determining whether a subject is likely to respond to a prostate cancer therapy with a composition comprising cancer cells that have been rendered proliferation-incompetent and have been genetically engineered to express GM-CSF, comprising detecting an immune response against an antigen selected from the group consisting of HLA-A24, OTUB2, FLJ14668, NNAT, and cardiolipin, wherein detecting the immune response indicates that the subject is likely to respond to said prostate cancer therapy.

2. The method of claim 1, wherein the subject is a mammal.

3. The method of claim 1, wherein the subject is a human.

4. The method of claim 1, wherein the cancer cells are autologous.

5. The method of claim 1, wherein the cancer cells are allogeneic.

6. The method of claim 1, wherein the cancer cells are LnCaP cells or PC3 cells.

7. The method of claim 1, further comprising detecting an immune response against an antigen listed in Table 1, 2, 3, 4, 5, 6, 7, or 9, wherein detecting said immune response against an antigen listed in Table 1, 2, 3, 4, 5, 6, 7, or 9 indicates that the subject is likely to respond to said prostate cancer therapy.

8. The method of claim 1, wherein an immune response is detected against HLA-A24.

9. The method of claim 1, wherein an immune response is detected against OTUB2.

10. The method of claim 1, wherein an immune response is detected against FLJ14668.

11. The method of claim 1, wherein an immune response is detected against NNAT.

12. The method of claim 1, wherein an immune response is detected against cardiolipin.

13. The method of claim 1, wherein responsiveness to the cancer therapy is measured by decreased serum concentrations of tumor specific markers, increased overall survival time, increased progression-free survival, decreased tumor size, decreased bone metastasis marker response, increased impact on minimal residual disease, increased induction of antibody response to the cancer cells that have been rendered proliferation-incompetent, increased induction of delayed-type-hypersensitivity (DTH) response to injections of autologous tumor, increased induction of T cell response to autologous tumor or candidate tumor-associated antigens, increased impact on circulating T cell and dendritic cell numbers, phenotype, and function, cytokine response, decreased concentrations of prostate-specific antigen (PSA), reduced slope of PSA doubling time, increased PSA doubling time, reduced metastasis as measured by bone scan, increased time to progression, increased survival time as compared to the Halabi nomogram, decreased serum concentrations of ICTP, or decreased concentrations of serum C-reactive protein.

14. The method of claim 1, wherein the immune response is a humoral immune response.

15. A computer-implemented method for determining whether a subject is likely to respond to a prostate cancer therapy with a composition comprising cancer cells that have been rendered proliferation-incompetent and have been genetically engineered to express GM-CSF, comprising inputting into a computer memory data indicating whether an immune response against an antigen selected from the group consisting of HLA-A24, OTUB2, FLJ14668, NNAT, and cardiolipin is detected, inputting into the computer memory a correlation between an immune response against an antigen selected from the group consisting of HLA-A24, OTUB2, FLJ14668, NNAT, and cardiolipin and a likelihood of responding to said therapy, and determining whether the subject is likely to respond to said therapy.

16. The method of claim 15, wherein the subject is a mammal.

17. The method of claim 15, wherein the subject is a human.

18. The method of claim 15, wherein the cancer cells are autologous.

19. The method of claim 15, wherein the cancer cells are allogeneic.

20. The method of claim 15, wherein the cancer cells are LnCaP cells or PC3 cells.

21. The method of claim 15, further comprising inputting into a computer memory data indicating whether an immune response is detected against an antigen listed in Table 1, 2, 3, 4, 5, 6, 7, or 9, inputting into the computer memory a correlation between an immune response against an antigen listed in Table 1, 2, 3, 4, 5, 6, 7, or 9, and determining whether the subject is likely to respond to said therapy.

22. The method of claim 15, wherein an immune response is detected against HLA-A24.

23. The method of claim 15, wherein an immune response is detected against OTUB2.

24. The method of claim 15, wherein an immune response is detected against FLJ14668.

25. The method of claim 15, wherein an immune response is detected against NNAT.

26. The method of claim 15, wherein an immune response is detected against cardiolipin.

27. The method of claim 15, wherein responsiveness to the cancer therapy is measured by decreased serum concentrations of tumor specific markers, increased overall survival time, increased progression-free survival, decreased tumor size, decreased bone metastasis marker response, increased impact on minimal residual disease, increased induction of antibody response to the cancer cells that have been rendered proliferation-incompetent, increased induction of delayed-type-hypersensitivity (DTH) response to injections of autologous tumor, increased induction of T cell response to autologous tumor or candidate tumor-associated antigens, increased impact on circulating T cell and dendritic cell numbers, phenotype, and function, cytokine response, decreased concentrations of PSA, reduced slope of PSA doubling time, increased PSA doubling time, reduced metastasis as measured by bone scan, increased time to progression, increased survival time as compared to the Halabi nomogram, decreased serum concentrations of ICTP, or decreased concentrations of serum C-reactive protein.

28. The method of claim 15, wherein the immune response is a humoral immune response.

29. A method for determining whether a subject is responding to a prostate cancer therapy with a composition comprising cancer cells that have been rendered proliferation-incompetent and have been genetically engineered to express GM-CSF, comprising administering an effective amount of a composition comprising cancer cells that have been rendered proliferation-incompetent and have been genetically engineered to express GM-CSF, and detecting an immune response against an antigen selected from the group consisting of HLA-A24, OTUB2, FLJ14668, NNAT, and cardiolipin, wherein detecting the immune response indicates that the subject is responding to said prostate cancer therapy.

30. The method of claim 29, wherein the subject is a mammal.

31. The method of claim 29, wherein the subject is a human.

32. The method of claim 29, wherein the cancer cells are autologous.

33. The method of claim 29, wherein the cancer cells are allogeneic.

34. The method of claim 29, wherein the cancer cells are LnCaP cells or PC3 cells.

35. The method of claim 29, further comprising detecting an immune response against an antigen listed in Table 1, 2, 3, 4, 5, 6, 7, or 9, wherein detecting the immune response against an antigen listed in Table 1, 2, 3, 4, 5, 6, 7, or 9 indicates that the subject is responding to said prostate cancer therapy.

36. The method of claim 29, wherein an immune response is detected against HLA-A24.

37. The method of claim 29, wherein an immune response is detected against OTUB2.

38. The method of claim 29, wherein an immune response is detected against FLJ14668.

39. The method of claim 29, wherein an immune response is detected against NNAT.

40. The method of claim 29, wherein an immune response is detected against cardiolipin.

41. The method of claim 29, wherein responsiveness to the cancer therapy is measured by decreased serum concentrations of tumor specific markers, increased overall survival time, increased progression-free survival, decreased tumor size, decreased bone metastasis marker response, increased impact on minimal residual disease, increased induction of antibody response to the cancer cells that have been rendered proliferation-incompetent, increased induction of delayed-type-hypersensitivity (DTH) response to injections of autologous tumor, increased induction of T cell response to autologous tumor or candidate tumor-associated antigens, increased impact on circulating T cell and dendritic cell numbers, phenotype, and function, cytokine response, decreased concentrations of PSA, reduced slope of PSA doubling time, increased PSA doubling time, reduced metastasis as measured by bone scan, increased time to progression, increased survival time as compared to the Halabi nomogram, decreased serum concentrations of ICTP, or decreased concentrations of serum C-reactive protein.

42. The method of claim 29, wherein the immune response is a humoral immune response.

43. A computer-implemented method for determining whether a subject is responding to a prostate cancer therapy with a composition comprising cancer cells that have been rendered proliferation-incompetent and have been genetically engineered to express GM-CSF, comprising administering an effective amount of a composition comprising cancer cells that have been rendered proliferation-incompetent and have been genetically engineered to express GM-CSF, inputting into a computer memory data indicating whether an immune response against an antigen selected from the group consisting of HLA-A24, OTUB2, FLJ14668, NNAT, and cardiolipin is detected, inputting into the computer memory a correlation between an immune response against an antigen selected from the group consisting of HLA-A24, OTUB2, FLJ14668, NNAT, and cardiolipin and responsiveness to said therapy, and determining whether the subject is responding to said therapy.

44. The method of claim 43, wherein the subject is a mammal.

45. The method of claim 43, wherein the subject is a human.

46. The method of claim 43, wherein the cancer cells are autologous.

47. The method of claim 43, wherein the cancer cells are allogeneic.

48. The method of claim 43, wherein the cancer cells are LnCaP cells or PC3 cells.

49. The method of claim 43, further comprising detecting an immune response against an antigen listed in Table 1, 2, 3, 4, 5, 6, 7, or 9, wherein detecting the immune response against an antigen listed in Table 1, 2, 3, 4, 5, 6, 7, or 9 indicates that the subject is responding to said prostate cancer therapy.

50. The method of claim 43, wherein an immune response is detected against HLA-A24.

51. The method of claim 43, wherein an immune response is detected against OTUB2.

52. The method of claim 43, wherein an immune response is detected against FLJ14668.

53. The method of claim 43, wherein an immune response is detected against NNAT.

54. The method of claim 43, wherein an immune response is detected against cardiolipin.

55. The method of claim 43, wherein responsiveness to the cancer therapy is measured by decreased serum concentrations of tumor specific markers, increased overall survival time, increased progression-free survival, decreased tumor size, decreased bone metastasis marker response, increased impact on minimal residual disease, increased induction of antibody response to the cancer cells that have been rendered proliferation-incompetent, increased induction of delayed-type-hypersensitivity (DTH) response to injections of autologous tumor, increased induction of T cell response to autologous tumor or candidate tumor-associated antigens, increased impact on circulating T cell and dendritic cell numbers, phenotype, and function, cytokine response, decreased concentrations of PSA, reduced slope of PSA doubling time, increased PSA doubling time, reduced metastasis as measured by bone scan, increased time to progression, increased survival time as compared to the Halabi nomogram, decreased serum concentrations of ICTP, or decreased concentrations of serum C-reactive protein.

56. A method for determining whether a subject is responding to a prostate cancer therapy with a composition comprising cancer cells that have been rendered proliferation-incompetent and have been genetically engineered to express GM-CSF, comprising detecting an immune response against an antigen selected from the group consisting of HLA-A24, OTUB2, FLJ14668, NNAT, and cardiolipin, administering an effective amount of a composition comprising cancer cells that have been rendered proliferation-incompetent and have been genetically engineered to express GM-CSF, and detecting an immune response against the antigen selected from the group consisting of HLA-A24, OTUB2, FLJ14668, NNAT, and cardiolipin at a later second time, wherein an increase in the immune response detected at the later second time relative to the earlier first time indicates that the subject is responding to said prostate cancer therapy.

57. A computer-implemented method for determining whether a subject is responding to a prostate cancer therapy with a composition comprising cancer cells that have been rendered proliferation-incompetent and have been genetically engineered to express GM-CSF, comprising administering an effective amount of a composition comprising cancer cells that have been rendered proliferation-incompetent and have been genetically engineered to express GM-C SF, inputting into a computer memory data indicating whether an immune response against an antigen selected from the group consisting of HLA-A24, OTUB2, FLJ14668, NNAT, and cardiolipin is detected at a first time prior to said step of administering and at a later second time subsequent to said step of administering, inputting into the computer memory a correlation between an increase in the immune response against the antigen selected from the group consisting of HLA-A24, OTUB2, FLJ14668, NNAT, and cardiolipin at said later second time relative to said earlier first time and responsiveness to said therapy, and determining whether the subject is responding to said therapy.

* * * * *